(12) United States Patent
Brennan et al.

(10) Patent No.: US 8,129,117 B2
(45) Date of Patent: Mar. 6, 2012

(54) GENETIC MARKERS FOR ASSESSING RISK OF DEVELOPING BIPOLAR DISORDER

(75) Inventors: Mark David Brennan, Jeffersonville, IN (US); Timothy Lynn Ramsey, Shelbyville, KY (US)

(73) Assignee: SureGene LLC, Louisville, KY (US)

( * ) Notice: Subject to any disclaimer, the term of this patent is extended or adjusted under 35 U.S.C. 154(b) by 0 days.

(21) Appl. No.: 12/612,521

(22) Filed: Nov. 4, 2009

(65) Prior Publication Data
US 2010/0120046 A1    May 13, 2010

Related U.S. Application Data

(63) Continuation of application No. PCT/US2009/058459, filed on Sep. 25, 2009.

(60) Provisional application No. 61/100,176, filed on Sep. 25, 2008.

(51) Int. Cl.
C12Q 1/68    (2006.01)
C07H 21/04    (2006.01)
C12P 19/34    (2006.01)

(52) U.S. Cl. ............ 435/6.11; 536/24.3; 435/91.2

(58) Field of Classification Search .......... None
See application file for complete search history.

(56) References Cited

FOREIGN PATENT DOCUMENTS
WO    2006-072075    7/2006

OTHER PUBLICATIONS

Zuchner (Genetics in Medicine (2007) vol. 9, pp. 332-340).*
Le-Niculescu et al (Curent opinion in Pharamacology (2010) vol. 10, pp. 594-600).*
DB SNP rs22991100 (reproduced below (http://www.ncbi.nlm.nih.gov/projects/SNP/snp_ref.cgi?rs=2291100, downloaded Sep. 2, 2011).*
Braff et al., "Advances in endophenotyping schizophrenia," World Psychiatry, vol. 7(1), pp. 11-18 (2008).
Liu et al., "HTF9C gene of 22q11.21 region associates with schizophrenia having deficit-sustained attention," Psychiatr. Genet., vol. 17(6), pp. 333-338 (2007).
Pinhiero et al., "AKT1 and neurocognition in schizophrenia," Aust. N.Z.J. Psychiatry, vol. 41(2), pp. 169-177 (2007).
Stephens et al., "Association of the 5'-upstream regulatory region of the alpha7 nicotinic acetylcholine receptor subunit gene (CHRNA7) with schizophrenia," Schizophr. Res., vol. 109(1-3), pp. 102-112, Epub. (2009).
O'Donovan et al., "Identification of loci associated with schizophrenia by genome-wide association and follow-up," Nat. Genet., 40(9):1053-1055 (2008).
International Search Report issued in PCT/US2009/058459 on Aug. 24, 2010.
International Search Report issued in PCT/US2009/058487 on Aug. 13, 2010.
International Search Report issued in PCT/US2009/058483 on Aug. 13, 2010.

* cited by examiner

*Primary Examiner* — Steven Pohnert
(74) *Attorney, Agent, or Firm* — Fish & Richardson P.C.

(57) ABSTRACT

This document provides methods and materials related to genetic markers of Bipolar Disorder (BD) and Schizophrenia (SZ). For example, methods for using such genetic markers to assess risk of developing BD and/or SZ are provided, as are methods for making a differential diagnosis between BD and SZ.

17 Claims, No Drawings

GENETIC MARKERS FOR ASSESSING RISK OF DEVELOPING BIPOLAR DISORDER

CLAIM OF PRIORITY

This application is a continuation of International Patent Application No. PCT/US2009/058459, filed Sep. 25, 2009, which claims the benefit of U.S. Provisional Application Ser. No. 61/100,176, filed on Sep. 25, 2008, which are incorporated by reference in their entirety herein.

FEDERALLY SPONSORED RESEARCH OR DEVELOPMENT

This invention was made with government support under Grant No. R43 MH078437 awarded by the National Institutes of Health. The government has certain rights in the invention.

TECHNICAL FIELD

This invention relates to genetic markers of Bipolar Disorder (BD). For example, this document provides methods of using such genetic markers for assessing risk of developing BD.

BACKGROUND

The schizophrenia spectrum disorders include schizophrenia (SZ), schizotypal personality disorder (SPD), and schizoaffective disorder (SD). Schizophrenia (SZ) is considered a clinical syndrome, and is probably a constellation of several pathologies. Substantial heterogeneity is seen between cases, which is thought to reflect multiple overlapping etiologic factors, including both genetic and environmental contributions. SD is characterized by the presence of affective (depressive or manic) symptoms and schizophrenic symptoms within the same, uninterrupted episode of illness. SPD is characterized by a pervasive pattern of social and interpersonal deficits marked by acute discomfort with, and reduced capacity for, close relationships as well as by cognitive or perceptual distortions and eccentricities of behavior, beginning by early adulthood and present in a variety of contexts.

Bipolar Disorder (BD), which is also known as manic-depression or manic-depressive disorder, is characterized by mood that alternates between two emotional extremes, or poles: the sadness of depression and the euphoria of mania. BD includes the following clinical disorders: Bipolar I disorder, Bipolar II disorder, Bipolar mania, and Bipolar depression.

Both schizophrenia and bipolar disorder can be classified as psychotic disorders. Indeed, BD and SZ are clinical classifications rather than actual diseases. The two diagnoses share many common features, with BD subjects often suffering in particular from extensive delusions similar to those seen in SZ. Similarly, SZ patients often have substantial affective symptoms such as mania and depression. Indeed, BD and SZ can be considered two ends of a continuum of mental illness, with BD diagnosis focused more on affective symptoms (e.g., mania and depression) and SZ more focus on positive symptoms (e.g., hallucinations). The diagnosis given to a patient often depends on the symptoms presented at time of diagnosis, which may or may not reflect the full extent of that patient's disease.

Differential diagnosis represents a tremendous area of unmet medical need. One area in particular in which this unmet need is evident is choice of medication. Two prime examples are the use of SSRI antidepressants to treat affective symptoms in SZ (which would be counter-indicated in patients with a high BD vs SZ index) and antipsychotic treatment for some BD subjects. Other examples could include the addition of cognitive enhancers for subjects diagnosed with BD but scoring high for diagnosis of SZ vs BD.

Various genes and chromosomes have been implicated in etiology of SZ and BD. Many studies have suggested the presence of one or more important genes relating to SZ and BD on most or all of the autosomes (Williams et al., *Hum. Mol. Genet.* 8:1729-1739 (1999); Middleton et al., *Am. J. Hum. Genet.* 74:886-897 (2004); Matsuoka et al., *Synapse* 62:1-7 (2008); Fallin et al., *Am. J. Hum. Genet.* 77:918-936 (2005); Sklar et al., *Mol. Psychiatry* 13:558-569 (2008); Sun et al., *Am. J. Med. Genet. B Neuropsychiatr. Genet.* (2008); Badner et al., *Mol. Psychiatry* 7:405-411 (2002); Bennett et al., *Mol. Psychiatry* 7:189-200 (2002); Cooper-Casey et al., *Mol. Psychiatry* 10:651-656 (2005); Devlin et al., *Mol. Psychiatry* 7:689-694 (2002); Fallin et al., *Am. J. Hum. Genet.* 73:601-611 (2003); Ginns et al., *Proc. Natl. Acad. Sci. U.S.A* 95:15531-15536 (1998); Jablensky, *Mol. Psychiatry* (2006); Kirov et al., *J. Clin. Invest.* 115:1440-1448 (2005); Norton et al., *Curr. Opin. Psychiatry* 19:158-164 (2006); Owen et al., *Mol. Psychiatry* 9:14-27 (2004)) However, none of these prior studies have used high resolution genetic association methods to systematically compare genes involved in psychosis, SZ and BD. Neither have any of these studies demonstrated that genetic polymorphisms in the genes defined herein are important, in particular in the genetic etiology of psychosis, or BD.

Due to the severity of these disorders, especially the negative impact of a psychotic episode on a patient, and the diminishing recovery after each psychotic episode, there is a need to more conclusively identify individuals who have or are at risk of developing bipolar disorder (BD) or schizophrenia spectrum disorders in order to, for example, confirm clinical diagnoses, allow for prophylactic therapies, determine optimal therapies, and provide genetic counseling for prospective parents with a personal or family history of the disorder.

SUMMARY

This disclosure provides methods for identifying subjects who have or are at risk of developing psychosis, as well as making a differential diagnosis in subjects suspected of having either bipolar disorder (BD) or a schizophrenia spectrum disorder (SSD), e.g., SZ, based on detecting genetic variants in genes involved in a number of pathways including: glutamate signaling and metabolism, cell adhesion, cytoskeletal architecture, vesicle formation, and trafficking, G-protein coupled receptors, carrier proteins and transporters, cell cycle modulators, neuronal development, calcium/calmodulin signaling, neuropeptide signaling, and several additional genes identified by virtue of their interaction with genes in high impact pathways and their expression in the central nervous system. This disclosure also provides methods and materials relating to determining the genetic risk of developing BD. For example, the allelic and genotypic variants identified as described herein can be used for assessing genetic risk of BD or for making a differential diagnosis between BD and SZ. Specifically, the invention includes methods based on evaluation of SNPs for genes relating to psychosis or BD.

In one aspect, this document features methods for making a differential diagnosis between bipolar disorder (BD) and schizophrenia (SZ) in a human subject. The methods can include determining the identity of at least one allele of a single nucleotide polymorphism (SNP) listed in Table 1 and comparing the identity of the allele in the subject with a reference allele, wherein the reference allele is either an allele associated with BD (OR>1) or an allele associated with SZ (OR<1); and wherein the presence of an allele in the subject that is the same as a reference allele that is associated with BD indicates that the subject has an increased risk of developing BD, and the presence of an allele in the subject that is the same as a reference allele that is associated with SZ indicates that the subject has an increased risk of developing SZ. The SNP can be selected from the group consisting of SEQ ID NO:2701, 154, 2409, 371, 378, 515, 509, 2878, 576, and 957.

In another aspect, this document features methods for diagnosing, or determining risk of developing, psychosis, e.g., psychosis associated with bipolar disorder (BD) or schizophrenia (SZ), in a human subject. The methods can include determining the identity of at least one allele of a SNP listed in Table 2 and comparing the identity of the allele in the subject with a reference allele, wherein the reference allele is associated with psychosis; and wherein the presence of an allele in the subject that the same as the reference allele indicates that the subject has psychosis or has an increased risk of developing psychosis. The SNP can be selected from the group consisting of SEQ ID NOs: 906, 2591, 1285, 904, 951, 50, 1127, 112, and 268. Determining the identity of an allele can include obtaining a sample comprising DNA from the subject, and determining identity of the nucleotide at the polymorphic site. Determining the identity of the nucleotide can include contacting the sample with a probe specific for a selected allele of the polymorphism. Determining also can include detecting the formation of complexes between the probe and the selected allele of the polymorphism, wherein the formation of complexes between the probe and the test marker indicates the presence of the selected allele in the sample. Determining the identity of an allele can comprise determining the identity of the nucleotide at position 31 of one of SEQ ID NOs: 1-3141.

The subject can be a patient (i.e., a human patient) having or suspected of having BD or SZ. The subject can have one or more risk factors associated with BD or SZ. The risk factors associated with BD or SZ can include one or more of: a relative afflicted with BD or SZ; and a genetically based phenotypic trait associated with risk for a BD or SZ. The subject can have exhibited or presently be exhibiting symptoms of psychosis. The methods can further include selecting or excluding a subject for enrollment in a clinical trial based on the identity of the allele. The methods can further include stratifying a subject population for analysis of a clinical trial based on the identity of the allele in the subjects. The methods can further include confirming a diagnosis of a SZ or BD using psychometric instruments. The methods can further comprise selecting a treatment for BD if the allele in the subject is the same as a reference allele in a subject who has BD, or selecting a treatment for SZ if an allele in the subject is the same as a reference allele in a subject who has SZ. The methods can further include administering the selected treatment to the subject. In some embodiments, the treatment is a standard treatment for BD or SZ, e.g., a pharmaceutical treatment or psychotherapy.

The methods can further include recording the identity of the allele in a tangible medium. The tangible medium can comprise a computer-readable disk, a solid state memory device, or an optical storage device.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DETAILED DESCRIPTION

This document provides methods for assessing genetic risk for developing bipolar disorder and/or schizophrenia (SZ) based on evaluation of single nucleotide polymorphisms (SNPs). As described herein, bioinformatic and genetic analyses provided evidence of association of the disclosed SNPs and genotypes with these disorders. Specific allelic and genotypic variants identified herein can be used to assess genetic risk and to assist with differential diagnosis.

Definitions

As used herein, an "allele" is one of a pair or series of genetic variants of a polymorphism at a specific genomic location. A "BD risk allele" is an allele that is associated with increased risk of developing BD. A "BD allele" is an allele that is statistically more often associated with BD than with SZ in patients with psychosis. An "SZ allele" is an allele that is statistically more often associated with SZ than with BD in patients with psychosis. For example, using Table 1, Those SNPs that are high (OR>1) are BD alleles by this definition. Those that are low (OR<1) would be SZ alleles by this definition As used herein, "genotype" refers to the diploid combination of alleles for a given genetic polymorphism. A homozygous subject carries two copies of the same allele and a heterozygous subject carries two different alleles.

As used herein, "genetic model" refers to the manner in which an allele influences risk or differential diagnosis. In a "dominant model" the allele impacts the clinical state to the same extent whether present in one copy or two copies, i.e. whether homozygous or heterozygous. In a "recessive model" the allele impacts the clinical state only when homozygous. In an "additive model" the allele impacts the clinical state in proportion to the number of copies present, i.e. the homozygous state has twice the impact of the heterozygous state.

As used herein, a "haplotype" is one or a set of signature genetic changes (polymorphisms) that are normally grouped closely together on the DNA strand, and are usually inherited as a group; the polymorphisms are also referred to herein as "markers." A "haplotype" as used herein is information regarding the presence or absence of one or more genetic markers in a given chromosomal region in a subject. A haplotype can consist of a variety of genetic markers, including indels (insertions or deletions of the DNA at particular locations on the chromosome); single nucleotide polymorphisms (SNPs) in which a particular nucleotide is changed; microsatellites; and minisatellites.

Microsatellites (sometimes referred to as a variable number of tandem repeats or VNTRs) are short segments of DNA that have a repeated sequence, usually about 2 to 5 nucleotides long (e.g., CACACA), that tend to occur in non-coding DNA. Changes in the microsatellites sometimes occur during the genetic recombination of sexual reproduction, increasing or decreasing the number of repeats found at an allele, changing the length of the allele. Microsatellite markers are stable, polymorphic, easily analyzed and occur regularly throughout the genome, making them especially suitable for genetic analysis.

"Copy number variation" (CNV), as used herein, refers to variation from the normal diploid condition for a gene or polymorphism. Individual segments of human chromosomes can be deleted or duplicated such that the subject's two chromosome carry fewer than two copies of the gene or polymorphism (a deletion or deficiency) or two or more copies (a duplication).

"Linkage disequilibrium" refers to when the observed frequencies of haplotypes in a population does not agree with haplotype frequencies predicted by multiplying together the frequency of individual genetic markers in each haplotype.

The term "chromosome" as used herein refers to a gene carrier of a cell that is derived from chromatin and comprises DNA and protein components (e.g., histones). The conventional internationally recognized individual human genome chromosome numbering identification system is employed herein. The size of an individual chromosome can vary from one type to another with a given multi-chromosomal genome and from one genome to another. In the case of the human genome, the entire DNA mass of a given chromosome is usually greater than about 100,000,000 base pairs. For example, the size of the entire human genome is about $3\times10^9$ base pairs.

The term "gene" refers to a DNA sequence in a chromosome that codes for a product (either RNA or its translation product, a polypeptide). A gene contains a coding region and includes regions preceding and following the coding region (termed respectively "leader" and "trailer"). The coding region is comprised of a plurality of coding segments ("exons") and intervening sequences ("introns") between individual coding segments.

The term "probe" refers to an oligonucleotide. A probe can be single stranded at the time of hybridization to a target. As used herein, probes include primers, i.e., oligonucleotides that can be used to prime a reaction, e.g., a PCR reaction.

The term "label" or "label containing moiety" refers in a moiety capable of detection, such as a radioactive isotope or group containing same, and nonisotopic labels, such as enzymes, biotin, avidin, streptavidin, digoxygenin, luminescent agents, dyes, haptens, and the like. Luminescent agents, depending upon the source of exciting energy, can be classified as radioluminescent, chemiluminescent, bioluminescent, and photoluminescent (including fluorescent and phosphorescent). A probe described herein can be bound, e.g., chemically bound to label-containing moieties or can be suitable to be so bound. The probe can be directly or indirectly labeled.

The term "direct label probe" (or "directly labeled probe") refers to a nucleic acid probe whose label after hybrid formation with a target is detectable without further reactive processing of hybrid. The term "indirect label probe" (or "indirectly labeled probe") refers to a nucleic acid probe whose label after hybrid formation with a target is further reacted in subsequent processing with one or more reagents to associate therewith one or more moieties that finally result in a detectable entity.

The terms "target," "DNA target," or "DNA target region" refers to a nucleotide sequence that occurs at a specific chromosomal location. Each such sequence or portion is preferably at least partially, single stranded (e.g., denatured) at the time of hybridization. When the target nucleotide sequences are located only in a single region or fraction of a given chromosome, the term "target region" is sometimes used.

Targets for hybridization can be derived from specimens which include, but are not limited to, chromosomes or regions of chromosomes in normal, diseased or malignant human cells, either interphase or at any state of meiosis or mitosis, and either extracted or derived from living or postmortem tissues, organs or fluids; germinal cells including sperm and egg cells, or cells from zygotes, fetuses, or embryos, or chorionic or amniotic cells, or cells from any other germinating body; cells grown in vitro, from either long-term or short-term culture, and either normal, immortalized or transformed; inter- or intraspecific hybrids of different types of cells or differentiation states of these cells; individual chromosomes or portions of chromosomes, or translocated, deleted or other damaged chromosomes, isolated by any of a number of means known to those with skill in the art, including libraries of such chromosomes cloned and propagated in prokaryotic or other cloning vectors, or amplified in vitro by means well known to those with skill; or any forensic material, including but not limited to blood, or other samples.

The term "hybrid" refers to the product of a hybridization procedure between a probe and a target.

The term "hybridizing conditions" has general reference to the combinations of conditions that are employable in a given hybridization procedure to produce hybrids, such conditions typically involving controlled temperature, liquid phase, and contact between a probe (or probe composition) and a target. Conveniently and preferably, at least one denaturation step precedes a step wherein a probe or probe composition is contacted with a target. Guidance for performing hybridization reactions can be found in Ausubel et al., *Current Protocols in Molecular Biology*, John Wiley & Sons, N.Y. (2003), 6.3.1-6.3.6. Aqueous and nonaqueous methods are described in that reference and either can be used. Hybridization conditions referred to herein are a 50% formamide, 2×SSC wash for 10 minutes at 45° C. followed by a 2×SSC wash for 10 minutes at 37° C.

Calculations of "identity" between two sequences can be performed as follows. The sequences are aligned for optimal comparison purposes (e.g., gaps can be introduced in one or both of a first and a second nucleic acid sequence for optimal alignment and non-identical sequences can be disregarded for comparison purposes). The length of a sequence aligned for comparison purposes is at least 30% (e.g., at least 40%, 50%, 60%, 70%, 80%, 90% or 100%) of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In some embodiments, the percent identity between two nucleotide sequences is determined using the GAP program in the GCG software package, using a Blossum 62 scoring matrix with a gap penalty of 12, a gap extend penalty of 4, and a frameshift gap penalty of 5.

As used herein, the term "substantially identical" is used to refer to a first nucleotide sequence that contains a sufficient number of identical nucleotides to a second nucleotide sequence such that the first and second nucleotide sequences have similar activities. Nucleotide sequences that are substantially identical are at least 80% (e.g., 85%, 90%, 95%, 97% or more) identical.

The term "nonspecific binding DNA" refers to DNA which is complementary to DNA segments of a probe, which DNA occurs in at least one other position in a genome, outside of a selected chromosomal target region within that genome. An example of nonspecific binding DNA comprises a class of DNA repeated segments whose members commonly occur in more than one chromosome or chromosome region. Such common repetitive segments tend to hybridize to a greater extent than other DNA segments that are present in probe composition.

As used herein, the term "stratification" refers to the creation of a distinction between subjects on the basis of a characteristic or characteristics of the subjects. Generally, in the context of clinical trials, the distinction is used to distinguish responses or effects in different sets of patients distinguished according to the stratification parameters. In some embodiments, stratification includes distinction of subject groups based on the presence or absence of particular alleles or genotypes described herein. The stratification can be performed, e.g., in the course of analysis, or can be used in creation of distinct groups or in other ways.

Methods of Differential Diagnosis (BD vs SZ) and Evaluation of Risk of Developing BD+SZ Described herein are a variety of methods for the diagnosis or determination of susceptibility to BD and SZ. "Susceptibility" does not necessarily mean that the subject will develop BD or SZ, but rather that the subject is, in a statistical sense, more likely to develop BD or SZ than an average member of the population (i.e., has an increased risk of developing BD or SZ). As used herein, susceptibility to BD or SZ exists if the subject has an allele or genotype associated with an increased risk of BD or SZ as described herein. Ascertaining whether the subject has such an allele or genotype is included in the concept of diagnosing susceptibility to BD or SZ as used herein. Such determination is useful, for example, for purposes of genetic counseling. Thus, the methods described herein can include obtaining a genotype associated with an increased risk of BD or SZ as described herein for the subject.

Additionally described herein are a variety of methods for the differential diagnosis of BD versus SZ. Differential diagnosis in this context means increased or decreased likelihood of being diagnosed with BD instead of SZ. Differential diagnosis does not necessarily mean that the subject will develop BD, but rather that the subject, in a statistical sense, has an increased or decreased likelihood of being diagnosed with BD instead of SZ. As used herein, differential diagnosis of BD exists if the subject has an allele or genotype associated with an increased or decreased likelihood of being diagnosed with BD versus SZ, as described herein. Ascertaining whether the subject has such an allele or genotype is included in the concept of differential diagnosis for BD and/or SZ as used herein. Such determination is useful, for example, for purposes of genetic counseling or selecting appropriate first line therapy. Thus, the methods described herein can include detecting the presence or identity of an allele or genotype associated with an increased or decreased likelihood of being diagnosed with BD and/or SZ as described herein for the subject. In some embodiments, the subject is exhibiting or has exhibited symptoms associate with psychosis.

As used herein, "determining the identity of an allele" includes obtaining information regarding the identity, presence or absence of one or more specific alleles in a subject. Determining the identity of an allele can, but need not, include obtaining a sample comprising DNA from a subject, and/or assessing the identity, presence or absence of one or more genetic markers in the sample. The individual or organization who determines the identity of the allele need not actually carry out the physical analysis of a sample from a subject; the methods can include using information obtained by analysis of the sample by a third party. Thus the methods can include steps that occur at more than one site. For example, a sample can be obtained from a subject at a first site, such as at a health care provider, or at the subject's home in the case of a self-testing kit. The sample can be analyzed at the same or a second site, e.g., at a laboratory or other testing facility.

Determining the identity of an allele can also include or consist of reviewing a subject's medical history, where the medical history includes information regarding the identity, presence or absence of one or more response alleles in the subject, e.g., results of a genetic test.

In some embodiments, to determine the identity of an allele or presence/absence of an allele or genotype described herein, a biological sample that includes nucleated cells (such as blood, a cheek swab or mouthwash) is prepared and analyzed for the presence or absence of preselected markers. Such diagnoses may be performed by diagnostic laboratories, or, alternatively, diagnostic kits can be manufactured and sold to health care providers or to private individuals for self-diagnosis. Diagnostic or prognostic tests can be performed as described herein or using well known techniques, such as described in U.S. Pat. No. 5,800,998.

Results of these tests, and optionally interpretive information, can be returned to the subject, the health care provider or to a third party payor. The results can be used in a number of ways. The information can be, e.g., communicated to the tested subject, e.g., with a prognosis and optionally interpretive materials that help the subject understand the test results and prognosis. The information can be used, e.g., by a health care provider, to determine whether to administer a specific drug, or whether a subject should be assigned to a specific category, e.g., a category associated with a specific disease endophenotype, or with drug response or non-response. The information can be used, e.g., by a third party payor such as a healthcare payer (e.g., insurance company or HMO) or other agency, to determine whether or not to reimburse a health care provider for services to the subject, or whether to approve the provision of services to the subject. For example, the healthcare payer may decide to reimburse a health care provider for treatments for BD if the subject has BD or has an increased risk of developing BD. The presence or absence of the allele or genotype in a patient may be ascertained by using any of the methods described herein.

Alleles and Genotypes Associated with BD and SZ, or BD vs SZ

This document provides methods for assessing genetic risk based on evaluation of single nucleotide polymorphisms (SNPs) for genes relating to risk of developing Bipolar Disorder (BD) or differential diagnosis between BD and SZ. Tables 1-2 and Table A list exemplary SNPs that can be used in the present methods. One of skill in the art will appreciate that additional variants can be identified via TDT using families with multiple affected individuals and verified by Case/Control comparisons, e.g., using the methods and markers described herein. Using the SNP markers described herein, one can determine the alleles, genotypes or haplotypes in these genes relating to diagnosis or genetic risk of developing BD and/or SZ. These alleles and genotypes can then be used to determine risk of developing BD and SZ, or for making a differential diagnosis between BD and SZ. The allelic and genotypic variants thus identified can be used for diagnosis and for assessing genetic risk.

Markers in Linkage disequilibrium (LD)

Linkage disequilibrium (LD) is a measure of the degree of association between alleles in a population. One of skill in the art will appreciate that alleles involving markers in LD with the polymorphisms described herein can also be used in a similar manner to those described herein. Methods of calculating LD are known in the art (see, e.g., Morton et al., *Proc. Natl. Acad. Sci. USA* 98(9):5217-21 (2001); Tapper et al., *Proc. Natl. Acad. Sci. USA* 102(33):11835-11839 (2005); Maniatis et al., *Proc. Natl. Acad. Sci. USA* 99:2228-2233 (2002)). Thus, in some cases, the methods can include analysis of polymorphisms that are in LD with a polymorphism described herein. Methods are known in the art for identifying such polymorphisms; for example, the International HapMap Project provides a public database that can be used, see hapmap.org, as well as The International HapMap Consortium, *Nature* 426:789-796 (2003), and The International HapMap Consortium, *Nature* 437:1299-1320 (2005). Generally, it will be desirable to use a HapMap constructed using data from individuals who share ethnicity with the subject. For example, a HapMap for African Americans would ideally be used to identify markers in LD with an exemplary marker described herein for use in genotyping a subject of African American descent.

Alternatively, methods described herein can include analysis of polymorphisms that show a correlation coefficient ($r^2$) of value $\geq 0.5$ with the markers described herein. Results can be obtained from on line public resources such as HapMap.org on the World Wide Web. The correlation coefficient is a measure of LD, and reflects the degree to which alleles at two loci (for example, two SNPs) occur together, such that an allele at one SNP position can predict the correlated allele at a second SNP position, in the case where $r^2$ is >0.5.

Identifying Additional Genetic Markers

In general, genetic markers can be identified using any of a number of methods well known in the art. For example, numerous polymorphisms in the regions described herein are known to exist and are available in public databases, which can be searched using methods and algorithms known in the art. Alternately, polymorphisms can be identified by sequencing either genomic DNA or cDNA in the region in which it is desired to find a polymorphism. According to one approach, primers are designed to amplify such a region, and DNA from a subject is obtained and amplified. The DNA is sequenced, and the sequence (referred to as a "subject sequence" or "test sequence") is compared with a reference sequence, which can represent the "normal" or "wild type" sequence, or the "affected" sequence. In some embodiments, a reference sequence can be from, for example, the human draft genome sequence, publicly available in various databases, or a sequence deposited in a database such as GenBank. In some embodiments, the reference sequence is a composite of ethnically diverse individuals.

In general, if sequencing reveals a difference between the sequenced region and the reference sequence, a polymorphism has been identified. The fact that a difference in nucleotide sequence is identified at a particular site that determines that a polymorphism exists at that site. In most instances, particularly in the case of SNPs, only two polymorphic variants will exist at any location. However, in the case of SNPs, up to four variants may exist since there are four naturally occurring nucleotides in DNA. Other polymorphisms, such as insertions and deletions, may have more than four alleles.

The methods described herein can also include determining the presence or absence of other markers known or suspected to be associated with risk of BD and/or SZ, or differentially inherited in BD versus SZ. In some embodiments, the methods include determining the presence or absence of one or more other markers that are or may be associated with BD or SZ, e.g., in one or more genes, e.g., e.g., as described in WO 2009/092032, WO 2009/089120, WO 2009/082743, US2006/0177851, and US2009/0012371 incorporated herein in their entirety. See also, e.g., OMIM entry no. 181500 (SCZD).

Methods of Determining the Identity of an Allele or Obtaining a Genotype

The methods described herein include determining the identity, presence or absence of alleles or genotypes associated with diagnosis or risk of developing BD and/or SZ, or differentially associated with BD versus SZ. In some embodiments, an association with BD is determined by the statistical likelihood of the presence of an allele or genotype in an individual with BD, e.g., an unrelated individual or a first or second-degree relation of the subject, and optionally the statistical likelihood of the absence of the same allele or genotype in an unaffected reference individual, e.g., an unrelated individual or a first or second-degree relation of the subject. In some embodiments, a differential association with BD versus SZ is determined by the statistical likelihood of the presence of the same genotype in both the subject and an affected reference individual, e.g., an unrelated individual or a first or second-degree relation of the subject, and the absence of the genotype in an unaffected reference individual. For example, an association with BD versus SZ is determined by the statistical likelihood of the presence of an allele or genotype in an individual with BD and the statistical likelihood of the absence of the same allele or genotype in a reference individual affected with SZ; likewise, an association with SZ versus BD is determined by the statistical likelihood of the presence of an allele or genotype in an individual with SZ and the statistical likelihood of the absence of the same allele or genotype in a reference individual affected with BD. Thus the methods can include obtaining and analyzing a sample from a suitable reference individual.

Samples that are suitable for use in the methods described herein contain genetic material, e.g., genomic DNA (gDNA). Genomic DNA is typically extracted from biological samples such as blood or mucosal scrapings of the lining of the mouth, but can be extracted from other biological samples including urine or expectorant. The sample itself will typically consist of nucleated cells (e.g., blood or buccal cells) or tissue removed from the subject. The subject can be an adult, child, fetus, or embryo. In some embodiments, the sample is obtained prenatally, either from a fetus or embryo or from the mother (e.g., from fetal or embryonic cells in the maternal circulation). Methods and reagents are known in the art for obtaining, processing, and analyzing samples. In some embodiments, the sample is obtained with the assistance of a health care provider, e.g., to draw blood. In some embodiments, the sample is obtained without the assistance of a health care provider, e.g., where the sample is obtained non-invasively, such as a sample comprising buccal cells that is obtained using a buccal swab or brush, or a mouthwash sample.

In some cases, a biological sample may be processed for DNA isolation. For example, DNA in a cell or tissue sample can be separated from other components of the sample. Cells can be harvested from a biological sample using standard techniques known in the art. For example, cells can be harvested by centrifuging a cell sample and resuspending the pelleted cells. The cells can be resuspended in a buffered solution such as phosphate-buffered saline (PBS). After centrifuging the cell suspension to obtain a cell pellet, the cells can be lysed to extract DNA, e.g., gDNA. See, e.g., Ausubel et al., 2003, supra. The sample can be concentrated and/or purified to isolate DNA. All samples obtained from a subject, including those subjected to any sort of further processing, are considered to be obtained from the subject. Routine methods can be used to extract genomic DNA from a biological sample, including, for example, phenol extraction. Alternatively, genomic DNA can be extracted with kits such as the QIAamp® Tissue Kit (Qiagen, Chatsworth, Calif.) and the Wizard® Genomic DNA purification kit (Promega). Non-limiting examples of sources of samples include urine, blood, and tissue.

The absence or presence of an allele or genotype associated with BD and/or SZ as described herein can be determined using methods known in the art. For example, gel electrophoresis, capillary electrophoresis, size exclusion chromatography, sequencing, and/or arrays can be used to detect the presence or absence of the allele or genotype. Amplification of nucleic acids, where desirable, can be accomplished using methods known in the art, e.g., PCR. In one example, a sample (e.g., a sample comprising genomic DNA), is obtained from a subject. The DNA in the sample is then examined to identify or detect the presence of an allele or genotype as described herein. The allele or genotype can be identified or determined by any method described herein, e.g., by sequencing or by hybridization of the gene in the genomic DNA, RNA, or cDNA to a nucleic acid probe, e.g., a DNA probe (which includes cDNA and oligonucleotide probes) or an RNA probe. The nucleic acid probe can be designed to specifically or preferentially hybridize with a particular polymorphic variant.

Other methods of nucleic acid analysis can include direct manual sequencing (Church and Gilbert, *Proc. Natl. Acad. Sci. USA* 81:1991-1995 (1988); Sanger et al., *Proc. Natl. Acad. Sci. USA* 74:5463-5467 (1977); Beavis et al., U.S. Pat. No. 5,288,644); automated fluorescent sequencing; single-stranded conformation polymorphism assays (SSCP) (Schafer et al., *Nat. Biotechnol.* 15:33-39 (1995)); clamped denaturing gel electrophoresis (CDGE); two-dimensional gel electrophoresis (2DGE or TDGE); conformational sensitive gel electrophoresis (CSGE); denaturing gradient gel electrophoresis (DGGE) (Sheffield et al., *Proc. Natl. Acad. Sci. USA* 86:232-236 (1989)); denaturing high performance liquid chromatography (DHPLC, Underhill et al., *Genome Res.* 7:996-1005 (1997)); infrared matrix-assisted laser desorption/ionization (IR-MALDI) mass spectrometry (WO 99/57318); mobility shift analysis (Orita et al., *Proc. Natl. Acad. Sci. USA* 86:2766-2770 (1989)); restriction enzyme analysis (Flavell et al., *Cell* 15:25 (1978); Geever et al., *Proc. Natl. Acad. Sci. USA* 78:5081 (1981)); quantitative real-time PCR (Raca et al., *Genet Test* 8(4):387-94 (2004)); heteroduplex analysis; chemical mismatch cleavage (CMC) (Cotton et al., *Proc. Natl. Acad. Sci. USA* 85:4397-4401 (1985)); RNase protection assays (Myers et al., *Science* 230:1242 (1985)); use of polypeptides that recognize nucleotide mismatches, e.g., *E. coli* mutS protein; allele-specific PCR, and combinations of such methods. See, e.g., Gerber et al., U.S. Patent Publication No. 2004/0014095 which is incorporated herein by reference in its entirety.

Sequence analysis can also be used to detect specific polymorphic variants. For example, polymorphic variants can be detected by sequencing exons, introns, 5' untranslated sequences, or 3' untranslated sequences. A sample comprising DNA or RNA is obtained from the subject. PCR or other appropriate methods can be used to amplify a portion encompassing the polymorphic site, if desired. The sequence is then ascertained, using any standard method, and the presence of a polymorphic variant is determined. Real-time pyrophosphate DNA sequencing is yet another approach to detection of polymorphisms and polymorphic variants (Alderborn et al., *Genome Research* 10(8):1249-1258 (2000)). Additional methods include, for example, PCR amplification in combination with denaturing high performance liquid chromatography (dHPLC) (Underhill et al., *Genome Research* 7(10): 996-1005 (1997)).

In order to detect polymorphisms and/or polymorphic variants, it will frequently be desirable to amplify a portion of genomic DNA (gDNA) encompassing the polymorphic site. Such regions can be amplified and isolated by PCR using oligonucleotide primers designed based on genomic and/or cDNA sequences that flank the site. PCR refers to procedures in which target nucleic acid (e.g., genomic DNA) is amplified in a manner similar to that described in U.S. Pat. No. 4,683, 195, and subsequent modifications of the procedure described therein. Generally, sequence information from the ends of the region of interest or beyond are used to design oligonucleotide primers that are identical or similar in sequence to opposite strands of a potential template to be amplified. See e.g., *PCR Primer: A Laboratory Manual*, Dieffenbach and Dveksler, (Eds.); McPherson et al., *PCR Basics: From Background to Bench* (Springer Verlag, 2000); Mattila et al., *Nucleic Acids Res.*, 19:4967 (1991); Eckert et al., *PCR Methods and Applications*, 1:17 (1991); PCR (eds. McPherson et al., IRL Press, Oxford); and U.S. Pat. No. 4,683,202. Other amplification methods that may be employed include the ligase chain reaction (LCR) (Wu and Wallace, *Genomics* 4:560 (1989), Landegren et al., *Science* 241:1077 (1988), transcription amplification (Kwoh et al., *Proc. Natl. Acad. Sci. USA* 86:1173 (1989)), self-sustained sequence replication (Guatelli et al., *Proc. Nat. Acad. Sci. USA* 87:1874 (1990)), and nucleic acid based sequence amplification (NASBA). Guidelines for selecting primers for PCR amplification are well known in the art. See, e.g., McPherson et al., *PCR Basics: From Background to Bench*, Springer-Verlag, 2000. A variety of computer programs for designing primers are available, e.g., 'Oligo' (National Biosciences, Inc, Plymouth Minn.), MacVector (Kodak/IBI), and the GCG suite of sequence analysis programs (Genetics Computer Group, Madison, Wis. 53711).

In some cases, PCR conditions and primers can be developed that amplify a product only when the variant allele is present or only when the wild type allele is present (MSPCR or allele-specific PCR). For example, patient DNA and a control can be amplified separately using either a wild type primer or a primer specific for the variant allele. Each set of reactions is then examined for the presence of amplification products using standard methods to visualize the DNA. For example, the reactions can be electrophoresed through an agarose gel and the DNA visualized by staining with ethidium bromide or other DNA intercalating dye. In DNA samples from heterozygous patients, reaction products would be detected in each reaction.

Real-time quantitative PCR can also be used to determine copy number. Quantitative PCR permits both detection and quantification of specific DNA sequence in a sample as an absolute number of copies or as a relative amount when normalized to DNA input or other normalizing genes. A key feature of quantitative PCR is that the amplified DNA product is quantified in real-time as it accumulates in the reaction after each amplification cycle. Methods of quantification can include the use of fluorescent dyes that intercalate with double-stranded DNA, and modified DNA oligonucleotide probes that fluoresce when hybridized with a complementary DNA. Methods of quantification can include determining the intensity of fluorescence for fluorescently tagged molecular probes attached to a solid surface such as a microarray.

The first report of extensive copy number variation (CNV) in the human genome used intensity analysis of microarray data to document numerous examples of genes that vary in copy number (Redon et al., Nature 444(7118):444-54 (2006)). Subsequent studies have shown that certain copy number variants are associated with complex genetic diseases such as SZ (Walsh et al., Science 320(5875):539-43 (2008); and Stone et al., Nature 455(7210):237-41 (2008)).

In some embodiments, a peptide nucleic acid (PNA) probe can be used instead of a nucleic acid probe in the hybridization methods described above. PNA is a DNA mimetic with a peptide-like, inorganic backbone, e.g., N-(2-aminoethyl)glycine units, with an organic base (A, G, C, T or U) attached to the glycine nitrogen via a methylene carbonyl linker (see, e.g., Nielsen et al., *Bioconjugate Chemistry*, The American Chemical Society, 5:1 (1994)). The PNA probe can be designed to specifically hybridize to a nucleic acid comprising a polymorphic variant conferring susceptibility to or indicative of the presence of SZ.

In some cases, allele-specific oligonucleotides can also be used to detect the presence of a polymorphic variant. For example, polymorphic variants can be detected by performing allele-specific hybridization or allele-specific restriction digests. Allele specific hybridization is an example of a method that can be used to detect sequence variants, including complete genotypes of a subject (e.g., a mammal such as a human). See Stoneking et al., *Am. J. Hum. Genet.* 48:370-382 (1991); and Prince et al., *Genome Res.* 11:152-162 (2001). An "allele-specific oligonucleotide" (also referred to herein as an "allele-specific oligonucleotide probe") is an oligonucleotide that is specific for particular a polymorphism can be prepared using standard methods (see Ausubel et al., *Current Protocols in Molecular Biology*, supra). Allele-specific oligonucleotide probes typically can be approximately 10-50 base pairs, preferably approximately 15-30 base pairs, that specifically hybridizes to a nucleic acid region that contains a polymorphism. Hybridization conditions are selected such that a nucleic acid probe can specifically bind to the sequence of interest, e.g., the variant nucleic acid sequence. Such hybridizations typically are performed under high stringency as some sequence variants include only a single nucleotide difference. In some cases, dot-blot hybridization of amplified oligonucleotides with allele-specific oligonucleotide (ASO) probes can be performed. See, for example, Saiki et al., *Nature* (London) 324:163-166 (1986).

In some embodiments, allele-specific restriction digest analysis can be used to detect the existence of a polymorphic variant of a polymorphism, if alternate polymorphic variants of the polymorphism result in the creation or elimination of a restriction site. Allele-specific restriction digests can be performed in the following manner. A sample containing genomic DNA is obtained from the individual and genomic DNA is isolated for analysis. For nucleotide sequence variants that introduce a restriction site, restriction digest with the particular restriction enzyme can differentiate the alleles. In some cases, polymerase chain reaction (PCR) can be used to amplify a region comprising the polymorphic site, and restriction fragment length polymorphism analysis is conducted (see Ausubel et al., *Current Protocols in Molecular Biology*, supra). The digestion pattern of the relevant DNA fragment indicates the presence or absence of a particular polymorphic variant of the polymorphism and is therefore indicative of the presence or absence of susceptibility to BD and/or SZ. For sequence variants that do not alter a common restriction site, mutagenic primers can be designed that introduce a restriction site when the variant allele is present or when the wild type allele is present. For example, a portion of a nucleic acid can be amplified using the mutagenic primer and a wild type primer, followed by digest with the appropriate restriction endonuclease.

In some embodiments, fluorescence polarization template-directed dye-terminator incorporation (FP-TDI) is used to determine which of multiple polymorphic variants of a polymorphism is present in a subject (Chen et al., *Genome Research* 9(5):492-498 (1999)). Rather than involving use of allele-specific probes or primers, this method employs primers that terminate adjacent to a polymorphic site, so that extension of the primer by a single nucleotide results in incorporation of a nucleotide complementary to the polymorphic variant at the polymorphic site.

In some cases, DNA containing an amplified portion may be dot-blotted, using standard methods (see Ausubel et al., *Current Protocols in Molecular Biology*, supra), and the blot contacted with the oligonucleotide probe. The presence of specific hybridization of the probe to the DNA is then detected. Specific hybridization of an allele-specific oligonucleotide probe (specific for a polymorphic variant indicative of susceptibility to BD and/or SZ) to DNA from the subject is indicative of susceptibility to BD and/or SZ.

The methods can include determining the genotype of a subject with respect to both copies of the polymorphic site present in the genome. For example, the complete genotype may be characterized as −/−, as −/+, or as +/+, where a minus sign indicates the presence of the reference or wild type sequence at the polymorphic site, and the plus sign indicates the presence of a polymorphic variant other than the reference sequence. If multiple polymorphic variants exist at a site, this can be appropriately indicated by specifying which ones are present in the subject. Any of the detection means described herein can be used to determine the genotype of a subject with respect to one or both copies of the polymorphism present in the subject's genome.

Methods of nucleic acid analysis to detect polymorphisms and/or polymorphic variants can include, e.g., microarray analysis. Hybridization methods, such as Southern analysis, Northern analysis, or in situ hybridizations, can also be used (see Ausubel et al., *Current Protocols in Molecular Biology*, eds., John Wiley & Sons (2003)). To detect microdeletions, fluorescence in situ hybridization (FISH) using DNA probes that are directed to a putatively deleted region in a chromosome can be used. For example, probes that detect all or a part of a microsatellite marker can be used to detect microdeletions in the region that contains that marker.

In some embodiments, it is desirable to employ methods that can detect the presence of multiple polymorphisms (e.g., polymorphic variants at a plurality of polymorphic sites) in parallel or substantially simultaneously. Oligonucleotide arrays represent one suitable means for doing so. Other methods, including methods in which reactions (e.g., amplification, hybridization) are performed in individual vessels, e.g., within individual wells of a multi-well plate or other vessel may also be performed so as to detect the presence of multiple polymorphic variants (e.g., polymorphic variants at a plurality of polymorphic sites) in parallel or substantially simultaneously according to certain embodiments.

Nucleic acid probes can be used to detect and/or quantify the presence of a particular target nucleic acid sequence within a sample of nucleic acid sequences, e.g., as hybridization probes, or to amplify a particular target sequence within a sample, e.g., as a primer. Probes have a complimentary nucleic acid sequence that selectively hybridizes to the target nucleic acid sequence. In order for a probe to hybridize to a target sequence, the hybridization probe must have sufficient identity with the target sequence, i.e., at least 70% (e.g., 80%, 90%, 95%, 98% or more) identity to the target sequence. The probe sequence must also be sufficiently long so that the probe exhibits selectivity for the target sequence over non-target sequences. For example, the probe will be at least 20 (e.g., 25, 30, 35, 50, 100, 200, 300, 400, 500, 600, 700, 800, 900 or more) nucleotides in length. In some embodiments, the probes are not more than 30, 50, 100, 200, 300, 500, 750, or 1000 nucleotides in length. Probes are typically about 20 to about $1 \times 10^6$ nucleotides in length. Probes include primers, which generally refers to a single-stranded oligonucleotide probe that can act as a point of initiation of template-directed DNA synthesis using methods such as PCR (polymerase chain reaction), LCR (ligase chain reaction), etc., for amplification of a target sequence.

The probe can be a test probe such as a probe that can be used to detect polymorphisms in a region described herein (e.g., polymorphisms as described herein). For example, the probe can hybridize to an allele described herein. In some embodiments, the probe can bind to another marker sequence associated with SZ, SPD, SD or BD as described herein.

Control probes can also be used. For example, a probe that binds a less variable sequence, e.g., repetitive DNA associated with a centromere of a chromosome, can be used as a control. Probes that hybridize with various centromeric DNA and locus-specific DNA are available commercially, for example, from Vysis, Inc. (Downers Grove, Ill.), Molecular Probes, Inc. (Eugene, Oreg.), or from Cytocell (Oxfordshire, UK). Probe sets are available commercially such from Applied Biosystems, e.g., the Assays-on-Demand SNP kits Alternatively, probes can be synthesized, e.g., chemically or in vitro, or made from chromosomal or genomic DNA through standard techniques. For example, sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification via the polymerase chain reaction (PCR). See, for example, Nath and Johnson, *Biotechnic. Histochem.* 73(1):6-22 (1998); Wheeless et al., *Cytometry* 17:319-326 (1994); and U.S. Pat. No. 5,491,224.

In some embodiments, the probes are labeled, e.g., by direct labeling, with a fluorophore, an organic molecule that fluoresces after absorbing light of lower wavelength/higher energy. A directly labeled fluorophore allows the probe to be visualized without a secondary detection molecule. After covalently attaching a fluorophore to a nucleotide, the nucleotide can be directly incorporated into the probe with standard techniques such as nick translation, random priming, and PCR labeling. Alternatively, deoxycytidine nucleotides within the probe can be transaminated with a linker. The fluorophore then is covalently attached to the transaminated deoxycytidine nucleotides. See, e.g., U.S. Pat. No. 5,491,224.

Fluorophores of different colors can be chosen such that each probe in a set can be distinctly visualized. For example, a combination of the following fluorophores can be used: 7-amino-4-methylcoumarin-3-acetic acid (AMCA), TEXAS RED™ (Molecular Probes, Inc., Eugene, Oreg.), 5-(and-6)-carboxy-X-rhodamine, lissamine rhodamine B, 5-(and-6)-carboxyfluorescein, fluorescein-5-isothiocyanate (FITC), 7-diethylaminocoumarin-3-carboxylic acid, tetramethylrhodamine-5-(and-6)-isothiocyanate, 5-(and-6)-carboxytetramethylrhodamine, 7-hydroxycoumarin-3-carboxylic acid, 6-[fluorescein 5-(and-6)-carboxamido]hexanoic acid, N-(4, 4-difluoro-5,7-dimethyl-4-bora-3a,4a diaza-3-indacenepropionic acid, eosin-5-isothiocyanate, erythrosin-5-isothiocyanate, and CASCADE™ blue acetylazide (Molecular Probes, Inc., Eugene, Oreg.). Fluorescently labeled probes can be viewed with a fluorescence microscope and an appropriate filter for each fluorophore, or by using dual or triple band-pass filter sets to observe multiple fluorophores. See, for example, U.S. Pat. No. 5,776,688. Alternatively, techniques such as flow cytometry can be used to examine the hybridization pattern of the probes. Fluorescence-based arrays are also known in the art.

In other embodiments, the probes can be indirectly labeled with, e.g., biotin or digoxygenin, or labeled with radioactive isotopes such as $^{32}P$ and $^{3}H$. For example, a probe indirectly labeled with biotin can be detected by avidin conjugated to a detectable marker. For example, avidin can be conjugated to an enzymatic marker such as alkaline phosphatase or horseradish peroxidase. Enzymatic markers can be detected in standard colorimetric reactions using a substrate and/or a catalyst for the enzyme. Catalysts for alkaline phosphatase include 5-bromo-4-chloro-3-indolylphosphate and nitro blue tetrazolium. Diaminobenzoate can be used as a catalyst for horseradish peroxidase.

In another aspect, this document features arrays that include a substrate having a plurality of addressable areas, and methods of using them. At least one area of the plurality includes a nucleic acid probe that binds specifically to a sequence comprising a polymorphism listed in Tables 1-2 or Table A, and can be used to detect the absence or presence of said polymorphism, e.g., one or more SNPs, microsatellites, minisatellites, or indels, as described herein, to determine or identify an allele or genotype. For example, the array can include one or more nucleic acid probes that can be used to detect a polymorphism listed in Tables 1-2 or Table A. In some embodiments, the array further includes at least one area that includes a nucleic acid probe that can be used to specifically detect another marker associated with BD and/or SZ as described herein. In some embodiments, the probes are nucleic acid capture probes.

Generally, microarray hybridization is performed by hybridizing a nucleic acid of interest (e.g., a nucleic acid encompassing a polymorphic site) with the array and detecting hybridization using nucleic acid probes. In some cases, the nucleic acid of interest is amplified prior to hybridization. Hybridization and detecting are generally carried out according to standard methods. See, e.g., Published PCT Application Nos. WO 92/10092 and WO 95/11995, and U.S. Pat. No. 5,424,186. For example, the array can be scanned to determine the position on the array to which the nucleic acid hybridizes. The hybridization data obtained from the scan is typically in the form of fluorescence intensities as a function of location on the array.

Arrays can be formed on substrates fabricated with materials such as paper, glass, plastic (e.g., polypropylene, nylon, or polystyrene), polyacrylamide, nitrocellulose, silicon, optical fiber, or any other suitable solid or semisolid support, and can be configured in a planar (e.g., glass plates, silicon chips) or three dimensional (e.g., pins, fibers, beads, particles, microtiter wells, capillaries) configuration. Methods for generating arrays are known in the art and include, e.g., photolithographic methods (see, e.g., U.S. Pat. Nos. 5,143,854; 5,510,270; and 5,527,681), mechanical methods (e.g., directed-flow methods as described in U.S. Pat. No. 5,384, 261), pin-based methods (e.g., as described in U.S. Pat. No. 5,288,514), and bead-based techniques (e.g., as described in PCT US/93/04145). The array typically includes oligonucleotide hybridization probes capable of specifically hybridizing to different polymorphic variants. Oligonucleotide probes that exhibit differential or selective binding to polymorphic sites may readily be designed by one of ordinary skill in the art. For example, an oligonucleotide that is perfectly complementary to a sequence that encompasses a polymorphic site (i.e., a sequence that includes the polymorphic site, within it or at one end) will generally hybridize preferentially to a nucleic acid comprising that sequence, as opposed to a nucleic acid comprising an alternate polymorphic variant.

Oligonucleotide probes forming an array may be attached to a substrate by any number of techniques, including, without limitation, (i) in situ synthesis (e.g., high-density oligonucleotide arrays) using photolithographic techniques; (ii) spotting/printing at medium to low density on glass, nylon or nitrocellulose; (iii) by masking, and (iv) by dot-blotting on a nylon or nitrocellulose hybridization membrane. Oligonucleotides can be immobilized via a linker, including by covalent, ionic, or physical linkage. Linkers for immobilizing nucleic acids and polypeptides, including reversible or cleavable linkers, are known in the art. See, for example, U.S. Pat. No. 5,451,683 and WO98/20019. Alternatively, oligonucleotides can be non-covalently immobilized on a substrate by hybridization to anchors, by means of magnetic beads, or in a fluid phase such as in microtiter wells or capillaries. Immobilized oligonucleotide probes are typically about 20 nucleotides in length, but can vary from about 10 nucleotides to about 1000 nucleotides in length.

Arrays can include multiple detection blocks (i.e., multiple groups of probes designed for detection of particular polymorphisms). Such arrays can be used to analyze multiple different polymorphisms. Detection blocks may be grouped within a single array or in multiple, separate arrays so that varying conditions (e.g., conditions optimized for particular polymorphisms) may be used during the hybridization. For example, it may be desirable to provide for the detection of those polymorphisms that fall within G-C rich stretches of a genomic sequence, separately from those falling in A-T rich segments. General descriptions of using oligonucleotide arrays for detection of polymorphisms can be found, for example, in U.S. Pat. Nos. 5,858,659 and 5,837,832. In addition to oligonucleotide arrays, cDNA arrays may be used similarly in certain embodiments.

The methods described herein can include providing an array as described herein; contacting the array with a sample (e.g., a portion of genomic DNA that includes at least a portion of a human chromosome) and/or optionally, a different portion of genomic DNA (e.g., a portion that includes a different portion of a human chromosome, e.g., including another region associated with BD and/or SZ), and detecting binding of a nucleic acid from the sample to the array. Optionally, the method includes amplifying nucleic acid from the sample, e.g., genomic DNA that includes a portion of a human chromosome described herein, and, optionally, a region that includes another region associated with BD and/or SZ, prior to or during contact with the array.

In some aspects, the methods described herein can include using an array that can ascertain differential expression patterns or copy numbers of one or more genes in samples from normal and affected individuals (see, e.g., Redon et al., *Nature* 444(7118):444-54 (2006)). For example, arrays of probes to a marker described herein can be used to measure polymorphisms between DNA from a subject having BD and/or SZ, and control DNA, e.g., DNA obtained from an individual that does not have BD and/or SZ, and has no risk factors for BD and/or SZ. Since the clones on the array contain sequence tags, their positions on the array are accurately known relative to the genomic sequence. Different hybridization patterns between DNA from an individual afflicted with BD and/or SZ and DNA from a normal individual at areas in the array corresponding to markers as described herein, and, optionally, one or more other regions associated with BD and/or SZ, are indicative of a risk of BD and/or SZ. Methods for array production, hybridization, and analysis are described, e.g., in Snijders et al., *Nat. Genetics* 29:263-264 (2001); Klein et al., *Proc. Natl. Acad. Sci. USA* 96:4494-4499 (1999); Albertson et al., *Breast Cancer Research and Treatment* 78:289-298 (2003); and Snijders et al., "BAC microarray based comparative genomic hybridization," in: Zhao et al. (eds), *Bacterial Artificial Chromosomes: Methods and Protocols*, Methods in Molecular Biology, Humana Press, 2002.

In another aspect, this document provides methods of determining the absence or presence of an allele or genotype associated with BD and/or SZ as described herein, using an array described above. The methods can include providing a two dimensional array having a plurality of addresses, each address of the plurality being positionally distinguishable from each other address of the plurality having a unique nucleic acid capture probe, contacting the array with a first sample from a test subject who is suspected of having or being at risk for BD and/or SZ, and comparing the binding of the first sample with one or more references, e.g., binding of a sample from a subject who is known to have BD and/or SZ, and/or binding of a sample from a subject who is unaffected, e.g., a control sample from a subject who neither has, nor has any risk factors for BD and/or SZ. In some embodiments, the methods can include contacting the array with a second sample from a subject who has BD and/or SZ; and comparing the binding of the first sample with the binding of the second sample. In some embodiments, the methods can include contacting the array with a third sample from a cell or subject that does not have BD and/or SZ and is not at risk for BD and/or SZ; and comparing the binding of the first sample with the binding of the third sample. In some embodiments, the second and third samples are from first or second-degree relatives of the test subject. In the case of a nucleic acid hybridization, binding with a capture probe at an address of the plurality, can be detected by any method known in the art, e.g., by detection of a signal generated from a label attached to the nucleic acid.

Bipolar Disorder and Schizophrenia Spectrum Disorders

The methods described herein can be used to determine a differential diagnosis based on the presence or absence of an allele or genotype associated with BD or with a schizophrenia spectrum disorder (SSD). The SSDs include schizophrenia (SZ), schizotypal personality disorder (SPD), and schizoaffective disorder (SD). Methods for diagnosing SSDs are known in the art, see, e.g., the *Diagnostic and Statistical Manual of Mental Disorders—Fourth Edition* ("DSM-IV"). See also, e.g., WO 2009/092032, incorporated herein by reference.

Bipolar Disorder, which is also known as manic-depression or manic-depressive disorder, is characterized by mood that alternates between two emotional extremes, or poles: the sadness of depression and the euphoria of mania (see symptoms of mania below).

People with bipolar disorder experience a wide range of feelings depending on the phase of the illness is present. Between these emotional swings, there are periods when a person's mood is quite normal. During the depressed phase of bipolar illness, the individual will have the same symptoms as those found in major depressive disorder, and the symptoms can be severe. The individual may have despondent mood, a loss of energy, feelings of worthlessness or guilt, or problems with concentration. Thoughts of suicide are not uncommon. In fact, 10% to 15% of those with bipolar disorder may die by suicide.

During the manic phase, the individual experiences mood that is extremely elevated, expansive, or irritable. Mania can seriously impair one's normal judgment, and the individual may not be able to realize the harm of his or her behavior and may even lose touch with reality. The individual becomes euphoric, ideas come much too fast, and concentration is nearly impossible. The individual's judgment is impaired, and he or she may behave recklessly without a sense of consequence. If a person with bipolar disorder experiences a severe manic episode, he or she may be abusive to children, spouses, or engage in other violent behaviors. When this happens, people often need to be hospitalized for their own safety and for the safety of others. There may also be problems with attendance and performance at school or work, as well as significant difficulties in personal relationships.

There are two types of bipolar disorder. Bipolar I Disorder is diagnosed when a person has had at least one manic or mixed episode, often along with a major depressive episode. It affects equal numbers of men and women in approximately 0.4% to 1.6% of the population. Bipolar II Disorder is diagnosed when a person has had a major depressive episode along with at least one hypomanic episode. It affects more women than men in about 0.5% of the population. Bipolar I disorder affects equal numbers of males and females, however there does appear to be a gender difference in the onset of the illness. Females are more likely to experience a first episode of depression, while males tend to have a first episode that is manic. Women who have bipolar I or II disorder and who have children may be at a higher risk of experiencing bipolar episodes within several months of giving birth. Of adolescents who have recurrent major depressive episodes, about 10%-15% of them will likely develop bipolar disorder. People who have immediate relatives with bipolar I disorder have a higher risk of developing a mood disorder themselves. For these people, the rate of developing bipolar II disorder or major depression is 4%-24% and bipolar I disorder is 1%-5%.

The cycles of bipolar disorder may be different for each person. Oftentimes a person may first experience depression. Depression may then be replaced with manic symptoms, and the cycle between depression and mania may continue for days, weeks, or months. Between phases of depression and mania some people return to their normal mood. Some others have several periods of either depression or mania. Still others may experience several bouts of depression with infrequent phases of hypomania, or repeated manic episodes with occasional depressive periods. A portion of people, roughly 10% to 20% may only experience mania, while others can have both depression and mania at the same time. For at least 90% of those who have bipolar disorder the condition is recurrent. They will experience future symptoms of the cycles of mania and depression. Approximately 60%-70% of manic episodes may happen just before or after a depressive episode, and this pattern may happen in a particular way for each person. Most people return to a regular level of functioning between episodes, while some (about 20%-30%) may continue to have some problems with mood stability and social and occupational functioning.

Diagnostic Criteria of Bipolar I Disorder

Diagnostic criteria for bipolar I disorder are known in the art. The following is summarized from the *Diagnostic and Statistical Manual of Mental Disorders—Fourth Edition*.

A. A person experiences a current or recent episode that is manic, hypomanic, mixed, or depressed.
  1. To be a manic episode, for at least one week a person's mood must be out of the ordinary and continuously heightened, exaggerated, or irritable.
  2. At least three of the following seven symptoms have been significant and enduring. If the mood is only irritable, then four symptoms are required.
    a. Self-esteem is excessive or grandiose.
    b. The need for sleep is greatly reduced.
    c. Talks much more than usual.
    d. Thoughts and ideas are continuous and without a pattern or focus.
    e. Easily distracted by unimportant things.
    f. An increase in purposeful activity or productivity, or behaving and feeling agitated.
    g. Reckless participation in enjoyable activities that create a high risk for negative consequences (e.g., extensive spending sprees, sexual promiscuity).
  3. The person's symptoms do not indicate a mixed episode.
  4. The person's symptoms are a cause of great distress or difficulty in functioning at home, work, or other important areas. Or, the symptoms require the person to be hospitalized to protect the person from harming himself/herself or others. Or, the symptoms include psychotic features (hallucinations, delusions).
  5. The person's symptoms are not caused by substance use (e.g., alcohol, drugs, medication), or a medical disorder.
B. Unless this is a first single manic episode there has been at least one manic, mixed, hypomanic, or depressive episode.
  1. For a major depressive episode a person must have experienced at least five of the nine symptoms below for the same two weeks or more, for most of the time almost every day, and this is a change from his/her prior level of functioning. One of the symptoms must be either (a) depressed mood, or (b) loss of interest.
    a. Depressed mood. For children and adolescents, this may be irritable mood.
    b. A significantly reduced level of interest or pleasure in most or all activities.
    c. A considerable loss or gain of weight (e.g., 5% or more change of weight in a month when not dieting). This may also be an increase or decrease in appetite. For children, they may not gain an expected amount of weight.
    d. Difficulty falling or staying asleep (insomnia), or sleeping more than usual (hypersomnia).
    e. Behavior that is agitated or slowed down. Others should be able to observe this.
    f. Feeling fatigued, or diminished energy.
    g. Thoughts of worthlessness or extreme guilt (not about being ill).
    h. Ability to think, concentrate, or make decisions is reduced.
    i. Frequent thoughts of death or suicide (with or without a specific plan), or attempt of suicide.
  2. The persons' symptoms do not indicate a mixed episode.
  3. The person's symptoms are a cause of great distress or difficulty in functioning at home, work, or other important areas.
  4. The person's symptoms are not caused by substance use (e.g., alcohol, drugs, medication), or a medical disorder.
  5. The person's symptoms are not due to normal grief or bereavement over the death of a loved one, they continue for more than two months, or they include great difficulty in functioning, frequent thoughts of worthlessness, thoughts of suicide, symptoms that are psychotic, or behavior that is slowed down (psychomotor retardation).

C. Another disorder does not better explain the episode.

Diagnostic Criteria of Bipolar II Disorder

Diagnostic criteria for bipolar II disorder are known in the art. The following is summarized from the *Diagnostic and Statistical Manual of Mental Disorders—Fourth Edition*.

A. The person currently has, or in the past has had at least one major depressive episode:
  1. For a major depressive episode a person must have experienced at least five of the nine symptoms below for the same two weeks or more, for most of the time almost every day, and this is a change from his/her prior level of functioning. One of the symptoms must be either (a) depressed mood, or (b) loss of interest.
     a. Depressed mood. For children and adolescents, this may be irritable mood.
     b. A significantly reduced level of interest or pleasure in most or all activities.
     c. A considerable loss or gain of weight (e.g., 5% or more change of weight in a month when not dieting). This may also be an increase or decrease in appetite. For children, they may not gain an expected amount of weight.
     d. Difficulty falling or staying asleep (insomnia), or sleeping more than usual (hypersomnia).
     e. Behavior that is agitated or slowed down. Others should be able to observe this.
     f. Feeling fatigued, or diminished energy.
     g. Thoughts of worthlessness or extreme guilt (not about being ill).
     h. Ability to think, concentrate, or make decisions is reduced.
     i. Frequent thoughts of death or suicide (with or without a specific plan), or attempt of suicide.
  2. The persons' symptoms do not indicate a mixed episode.
  3. The person's symptoms are a cause of great distress or difficulty in functioning at home, work, or other important areas.
  4. The person's symptoms are not caused by substance use (e.g., alcohol, drugs, medication), or a medical disorder.
  5. The person's symptoms are not due to normal grief or bereavement over the death of a loved one, they continue for more than two months, or they include great difficulty in functioning, frequent thoughts of worthlessness, thoughts of suicide, symptoms that are psychotic, or behavior that is slowed down (psychomotor retardation).

B. The person currently has, or in the past has had at least one hypomanic episode:
  1. For a hypomanic episode a person's mood must be out of the ordinary and continuously heightened, exaggerated, or irritable for at least four days.
  2. At least three of the following seven symptoms have been significant and enduring. If the mood is only irritable, then four symptoms are required.
     a. Self-esteem is excessive or grandiose.
     b. The need for sleep is greatly reduced.
     c. Talks much more than usual.
     d. Thoughts and ideas are continuous and without a pattern or focus.
     e. Easily distracted by unimportant things.
     f. An increase in purposeful activity or productivity, or behaving and feeling agitated.
     g. Reckless participation in enjoyable activities that create a high risk for negative consequences (e.g., extensive spending sprees, sexual promiscuity).
  3. The episode is a substantial change for the person and uncharacteristic of his or her usual functioning.
  4. The changes of functioning and mood can be observed by others.
  5. The person's symptoms are NOT severe enough to cause difficulty in functioning at home, work, or other important areas; the symptoms neither require the person to be hospitalized, nor are there any psychotic features.
  6. The person's symptoms are not caused by substance use (e.g., alcohol, drugs, medication), or a medical disorder.

C. The person has never experienced a manic or mixed episode.

D. Another disorder does not better explain the episode.

E. The symptoms are a cause of great distress or difficulty in functioning at home, work, or other important areas.

Communicating Risk Assessment

This document also provides methods and materials to assist medical or research professionals in determining whether or not a subject has or is at risk for developing BD and/or SZ. Medical professionals can be, for example, doctors, nurses, medical laboratory technologists, and pharmacists. Research professionals can be, for example, principle investigators, research technicians, postdoctoral trainees, and graduate students. A professional can be assisted by (1) determining whether specific polymorphic variants are present in a biological sample from a subject, and (2) communicating information about polymorphic variants to that professional.

After information about specific polymorphic variants is reported, a medical professional can take one or more actions that can affect patient care. For example, a medical professional can record information in the patient's medical record regarding the diagnosis or risk of the patient to develop BD and/or SZ. In some cases, a medical professional can record information regarding risk assessment, or otherwise transform the patient's medical record, to reflect the patient's current medical condition. In some cases, a medical professional can review and evaluate a patient's entire medical record and assess multiple treatment strategies for clinical intervention of a patient's condition.

A medical professional can initiate or modify treatment after receiving information regarding a patient's diagnosis of or risk of developing BD and/or SZ, for example. In some cases, a medical professional can recommend a change in therapy. In some cases, a medical professional can enroll a patient in a clinical trial for, by way of example, detecting correlations between an allele or genotype as described herein and any measurable or quantifiable parameter relating to the outcome of the treatment as described above.

A medical professional can communicate information regarding a patient's diagnosis of or risk of developing BD and/or SZ to a patient or a patient's family. In some cases, a medical professional can provide a patient and/or a patient's family with information regarding BD and/or SZ diagnosis and risk assessment information, including treatment options, prognosis, and referrals to specialists. In some cases, a medical professional can provide a copy of a patient's medical records to a specialist.

A research professional can apply information regarding a subject's diagnosis of or risk of developing BD and/or SZ to advance scientific research. For example, a researcher can compile data on wild specific polymorphic variants. In some cases, a research professional can obtain a subject's allele(s) or genotype as described herein to evaluate a subject's enrollment, or continued participation, in a research study or clinical trial. In some cases, a research professional can communicate information regarding a subject's diagnosis of or risk of developing BD and/or SZ to a medical professional. In some cases, a research professional can refer a subject to a medical professional.

Any appropriate method can be used to communicate information to another person (e.g., a professional). For example, information can be given directly or indirectly to a professional. For example, a laboratory technician can input a patient's polymorphic variant allele(s) or genotype as described herein into a computer-based record. In some cases, information is communicated by making an physical alteration to medical or research records. For example, a medical professional can make a permanent notation or flag a medical record for communicating the risk assessment to other medical professionals reviewing the record. In addition, any type of communication can be used to communicate the risk assessment information. For example, mail, e-mail, telephone, and face-to-face interactions can be used. The information also can be communicated to a professional by making that information electronically available to the professional. For example, the information can be communicated to a professional by placing the information on a computer database such that the professional can access the information. In addition, the information can be communicated to a hospital, clinic, or research facility serving as an agent for the professional.

Articles of Manufacture

Also provided herein are articles of manufacture comprising a probe that hybridizes with a region of human chromosome as described herein and can be used to detect a polymorphism described herein. For example, any of the probes for detecting polymorphisms described herein can be combined with packaging material to generate articles of manufacture or kits. The kit can include one or more other elements including: instructions for use; and other reagents such as a label or an agent useful for attaching a label to the probe. Instructions for use can include instructions for diagnostic applications of the probe for making a diagnosis of or assessing risk of BD and/or SZ in a method described herein. Other instructions can include instructions for attaching a label to the probe, instructions for performing in situ analysis with the probe, and/or instructions for obtaining a sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a biological sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the sample for analysis, e.g., to a laboratory. The kit can include one or more containers for the sample, or the sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the sample can be coded, for example, with a bar code for identifying the subject who provided the sample.

Databases and Reports

Also provided herein are databases that include a list of polymorphisms as described herein, and wherein the list is largely or entirely limited to polymorphisms identified as useful for determining a diagnosis or susceptibility to BD and/or SZ as described herein. The list is stored, e.g., on a flat file or computer-readable medium. The databases can further include information regarding one or more subjects, e.g., whether a subject is affected or unaffected, clinical information such as endophenotype, age of onset of symptoms, any treatments administered and outcomes (e.g., data relevant to pharmacogenomics, diagnostics or theranostics), and other details, e.g., about the disorder in the subject, or environmental or other genetic factors. The databases can be used to detect correlations between a particular allele or genotype and the information regarding the subject.

The methods described herein can also include the generation of reports, e.g., for use by a patient, care giver, payor, or researcher, that include information regarding a subject's response allele(s), and optionally further information such as treatments administered, treatment history, medical history, predicted response, and actual response. The reports can be recorded in a tangible medium, e.g., a computer-readable disk, a solid state memory device, or an optical storage device.

Engineered Cells

Also provided herein are engineered cells that harbor one or more polymorphism described herein, e.g., one or more polymorphisms associated with BD and/or SZ. Such cells are useful for studying the effect of a polymorphism on physiological function, and for identifying and/or evaluating potential therapeutic agents such as anti-psychotics for the treatment of BD and/or SZ.

As one example, included herein are cells in which one of the various alleles of the genes described herein has been re-created that is associated with an increased risk of BD and/or SZ. Methods are known in the art for generating cells, e.g., by homologous recombination between the endogenous gene and an exogenous DNA molecule introduced into a cell, e.g., a cell of an animal. In some cases, the cells can be used to generate transgenic animals using methods known in the art.

The cells are preferably mammalian cells (e.g., neuronal type cells) in which an endogenous gene has been altered to include a polymorphism as described herein. Techniques such as targeted homologous recombinations, can be used to insert the heterologous DNA as described in, e.g., Chappel, U.S. Pat. No. 5,272,071; WO 91/06667, published in May 16, 1991.

EXAMPLES

The invention is further described in the following examples, which do not limit the scope of the invention described in the claims.

Example 1

Genotypes and Alleles that Contribute to Differential Diagnosis of BD Versus SZ

Genotyping and phenotype data were obtained from the Genetic Analysis Information Network (GAIN) Database found at ncbi.nlm.nih.gov through dbGaP, at accession number PHS000017.v1.p1. Genotypes and associated phenotype data for the GAIN Genome-Wide Association Study of Schizophrenia were provided by P. Gejman, and genotyping of these samples was provided through the Genetic Association Information Network (GAIN). Data for 1018 BD cases, 1172 SZ cases and 1378 neurologically normal controls with Caucasian ancestry were evaluated for the GAIN sample.

To determine the significance of the relationship between each allele or genotype and diagnosis of either BD or SZ or BD vs SZ, Golden Helix's SNP and Variation Suite (SVS™) was used to determine a p-value using a trend/correlations test. This test showed the p-value for the dependent variable value having any correlation with or "trend", which depends on the (possibly PCA-corrected) count value of the genotype. (See below.) For case/control dependent variables, a "case" was considered to have a value of one, and a "control" was considered to have a value of zero. For the genotype predictor variable, the count values were as follows where the minor allele "D" is the allele shown in the table:

Additive Model: The count of the minor allele D, which is zero within genotype dd, one within genotype Dd, and two within genotype DD, where d is the major allele.

Dominant Model: The count is one for genotypes DD and Dd and zero for genotype dd.

Recessive Model: The count is one for genotype DD and zero for genotypes Dd and dd.

Table 1 lists alleles and genotypes influencing differential diagnosis for BD versus SZ. 1018 BD cases and 1170 SZ cases were used to identify these polymorphisms. In brief, each BD case was coded as a 1 (or case) and each SZ case was coded as 0 (or control). The Genetic Association Information Network (GAIN), a partnership between the NIH and private companies, provided genome wide genotyping data for SZ and BP (database of Genotype and Phenotype (dbGaP). National Institutes of Health 2008, available on the NCBI website). Using this coding and genotypes and phenotypes provided by GAIN, case control analysis was performed using various genetic models (recessive, dominant and additive) in Golden Helix's SNP and Variation Suite v 7.0 (SVS™). Table 1 lists the gene, SEQ ID NO:, NCBI RS number, test allele, genetic model, odds ratio (OR), and p-value for the comparison. In this example, an OR greater than 1 indicates that the subject has a greater likelihood of a BD diagnosis than a SZ diagnosis. Similarly, an OR less than 1 indicates that the subject has a lower likelihood of a BD diagnosis than a SZ diagnosis.

TABLE 1

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| KIF1B | 1 | 1555849 | G | RECESSIVE | 0.0168627 | 0.72 |
| PRDM2 | 2 | 876931 | C | DOMINANT | 0.0174243 | 1.25 |
| RP1-21O18.1 | 3 | 12035178 | G | ADDITIVE | 0.0068159 | 0.81 |
| RP1-21O18.1 | 4 | 6663699 | G | ADDITIVE | 0.0217698 | 0.86 |
| EPHB2 | 9 | 309473 | T | RECESSIVE | 0.0303631 | 1.25 |
| EPHB2 | 10 | 309471 | G | RECESSIVE | 0.0174109 | 1.28 |
| CLIC4 | 11 | 3131502 | A | RECESSIVE | 0.0372989 | 1.38 |
| CLIC4 | 12 | 9259 | C | RECESSIVE | 0.0162138 | 1.43 |
| AGBL4-C1ORF165 | 19 | 3122291 | T | RECESSIVE | 0.0056129 | 0.71 |
| AGBL4-C1ORF165 | 20 | 3121512 | C | RECESSIVE | 0.0178332 | 0.77 |
| AGBL4-C1ORF165 | 21 | 3118215 | A | RECESSIVE | 0.0347862 | 0.78 |
| AGBL4-C1ORF165 | 22 | 3118223 | G | RECESSIVE | 0.0270175 | 0.77 |
| AGBL4-C1ORF165 | 23 | 3121273 | G | RECESSIVE | 0.0354423 | 0.79 |
| AGBL4-C1ORF165 | 24 | 3127556 | G | RECESSIVE | 0.0312224 | 0.78 |
| AGBL4-C1ORF165 | 25 | 3121518 | A | RECESSIVE | 0.0227865 | 0.76 |
| AGBL4-C1ORF165 | 26 | 6669433 | A | RECESSIVE | 0.0349819 | 0.78 |
| AGBL4-C1ORF165 | 27 | 7520773 | T | RECESSIVE | 0.0050132 | 0.68 |
| SLC6A17 | 41 | 495959 | T | ADDITIVE | 0.0121511 | 0.88 |
| SLC16A4 | 42 | 10857820 | A | RECESSIVE | 0.0103223 | 1.32 |
| SLC16A4 | 43 | 4498805 | G | ADDITIVE | 0.0243463 | 0.86 |
| KCNA10 | 45 | 3748731 | A | ADDITIVE | 0.0188446 | 1.16 |
| SLC22A15 | 52 | 2488433 | T | ADDITIVE | 0.0096888 | 1.38 |
| SLC22A15 | 54 | 3748743 | A | ADDITIVE | 0.0148878 | 1.42 |
| CGN | 59 | 1547832 | A | DOMINANT | 0.0148568 | 0.78 |
| CGN | 60 | 10788807 | G | DOMINANT | 0.0154457 | 0.78 |
| CGN | 62 | 1418823 | T | DOMINANT | 0.0375351 | 0.70 |
| ATF6 | 63 | 905594 | T | ADDITIVE | 0.0234906 | 0.86 |
| ATF6 | 64 | 2070151 | T | DOMINANT | 0.0499978 | 0.78 |
| ATF6 | 65 | 1553443 | C | DOMINANT | 0.0315353 | 0.75 |
| ATF6 | 67 | 12405111 | A | ADDITIVE | 0.0338357 | 0.78 |
| ATF6 | 69 | 7530997 | A | DOMINANT | 0.0370491 | 0.77 |
| ATF6 | 70 | 12401299 | G | ADDITIVE | 0.0486075 | 0.82 |
| ATF6 | 71 | 16856629 | G | ADDITIVE | 0.0437555 | 0.80 |
| ATF6 | 72 | 7552420 | C | ADDITIVE | 0.0486075 | 0.82 |
| ATF6 | 73 | 12028953 | T | DOMINANT | 0.0489870 | 0.78 |
| ATF6 | 74 | 10918214 | G | ADDITIVE | 0.0491995 | 0.87 |
| ATF6 | 75 | 10918215 | G | ADDITIVE | 0.0491995 | 0.87 |
| ATF6 | 76 | 10753686 | A | ADDITIVE | 0.0491995 | 0.87 |
| ATF6 | 77 | 4657124 | G | ADDITIVE | 0.0409751 | 0.86 |
| ATF6 | 78 | 4657125 | C | ADDITIVE | 0.0491995 | 0.87 |
| FAM78B | 85 | 12030964 | T | DOMINANT | 0.0345563 | 0.82 |
| FAM78B | 86 | 10494453 | A | RECESSIVE | 0.0286683 | 0.67 |
| FAM78B | 87 | 9787101 | T | RECESSIVE | 0.0303146 | 0.68 |
| FAM78B | 88 | 715421 | A | RECESSIVE | 0.0149449 | 0.64 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| FAM78B | 89 | 10800198 | C | RECESSIVE | 0.0175647 | 0.65 |
| DPT | 90 | 511187 | G | ADDITIVE | 0.0264861 | 0.88 |
| SEC16B | 91 | 1889981 | A | ADDITIVE | 0.0217462 | 1.16 |
| CACNA1E | 96 | 199960 | T | DOMINANT | 0.0290569 | 0.83 |
| CACNA1E | 97 | 3766983 | C | DOMINANT | 0.0438431 | 0.83 |
| CACNA1E | 98 | 4652675 | G | DOMINANT | 0.0193933 | 0.82 |
| CACNA1E | 99 | 3845444 | G | DOMINANT | 0.0461923 | 0.84 |
| CACNA1E | 100 | 3843280 | G | ADDITIVE | 0.0219374 | 0.84 |
| CACNA1E | 101 | 704329 | A | RECESSIVE | 0.0256218 | 1.26 |
| CACNA1E | 102 | 546191 | T | ADDITIVE | 0.0134889 | 0.89 |
| PLA2G4A | 121 | 6662687 | A | RECESSIVE | 0.0323279 | 0.78 |
| KCNH1 | 122 | 1340128 | C | ADDITIVE | 0.0287026 | 0.87 |
| KCNH1 | 124 | 1777256 | A | ADDITIVE | 0.0433741 | 0.90 |
| KCNH1 | 128 | 17267442 | T | RECESSIVE | 0.0218244 | 0.69 |
| KCNK2 | 131 | 10864143 | A | RECESSIVE | 0.0246322 | 1.39 |
| USH2A | 142 | 17025416 | T | RECESSIVE | 0.0304882 | 4.73 |
| ESRRG | 143 | 12027901 | C | DOMINANT | 0.0438998 | 0.81 |
| SLC35F3 | 145 | 6688304 | A | ADDITIVE | 0.0075880 | 0.82 |
| SLC35F3 | 146 | 1463501 | G | ADDITIVE | 0.0136990 | 0.84 |
| SLC35F3 | 147 | 1563693 | G | ADDITIVE | 0.0092743 | 0.83 |
| SLC35F3 | 148 | 9435569 | T | ADDITIVE | 0.0075579 | 0.82 |
| SLC35F3 | 149 | 6674291 | C | ADDITIVE | 0.0107637 | 0.85 |
| SLC35F3 | 150 | 480993 | T | RECESSIVE | 0.0463714 | 0.76 |
| GNG4 | 151 | 508208 | G | ADDITIVE | 0.0133270 | 0.88 |
| GNG4 | 152 | 7554426 | G | DOMINANT | 0.0266180 | 1.22 |
| GNG4 | 153 | 7554532 | G | DOMINANT | 0.0336946 | 1.21 |
| RYR2 | 154 | 6684412 | C | DOMINANT | 0.0000058 | 1.49 |
| RYR2 | 155 | 884641 | T | ADDITIVE | 0.0242126 | 0.84 |
| CHRM3 | 159 | 12097526 | T | DOMINANT | 0.0021341 | 0.77 |
| FMN2 | 160 | 897662 | T | DOMINANT | 0.0069240 | 0.79 |
| FMN2 | 161 | 10926188 | G | DOMINANT | 0.0074822 | 0.79 |
| FMN2 | 165 | 10495466 | A | ADDITIVE | 0.0270938 | 1.34 |
| RGS7 | 166 | 2815871 | T | RECESSIVE | 0.0099288 | 2.30 |
| PLD5 | 167 | 2343119 | A | DOMINANT | 0.0046930 | 1.30 |
| PLD5 | 168 | 7542270 | G | DOMINANT | 0.0215593 | 1.23 |
| C2ORF46 | 169 | 11684514 | T | DOMINANT | 0.0205265 | 1.31 |
| C2ORF46 | 170 | 7577544 | G | DOMINANT | 0.0039917 | 1.38 |
| C2ORF46 | 171 | 11677028 | G | DOMINANT | 0.0068260 | 1.36 |
| DDEF2 | 172 | 11686324 | T | DOMINANT | 0.0173768 | 1.23 |
| DDEF2 | 173 | 2356779 | A | DOMINANT | 0.0098345 | 1.25 |
| DDEF2 | 174 | 2666218 | G | DOMINANT | 0.0130585 | 1.24 |
| DDEF2 | 175 | 6431996 | C | DOMINANT | 0.0139985 | 1.24 |
| DDEF2 | 176 | 16866981 | G | RECESSIVE | 0.0219219 | 1.34 |
| DDEF2 | 177 | 17627209 | G | ADDITIVE | 0.0219751 | 1.15 |
| DDEF2 | 178 | 10177742 | A | RECESSIVE | 0.0262729 | 1.33 |
| DDEF2 | 179 | 4610024 | G | RECESSIVE | 0.0393906 | 1.29 |
| DDEF2 | 180 | 17673165 | G | ADDITIVE | 0.0405321 | 1.14 |
| DDEF2 | 181 | 6743955 | C | RECESSIVE | 0.0301506 | 1.32 |
| DDEF2 | 182 | 10172687 | T | RECESSIVE | 0.0296340 | 1.32 |
| DDEF2 | 183 | 6736216 | G | RECESSIVE | 0.0219219 | 1.34 |
| DDEF2 | 184 | 13414373 | G | RECESSIVE | 0.0365651 | 1.31 |
| DDEF2 | 185 | 3811599 | C | RECESSIVE | 0.0310306 | 1.32 |
| DDEF2 | 186 | 4627537 | T | RECESSIVE | 0.0463321 | 1.29 |
| DDEF2 | 187 | 17522163 | A | ADDITIVE | 0.0344479 | 1.17 |
| DDEF2 | 188 | 10181704 | T | RECESSIVE | 0.0350575 | 1.31 |
| DDEF2 | 189 | 4392227 | G | ADDITIVE | 0.0345107 | 1.17 |
| DDEF2 | 190 | 13424953 | T | RECESSIVE | 0.0196379 | 1.35 |
| DDEF2 | 191 | 4599081 | G | RECESSIVE | 0.0294499 | 2.38 |
| KLHL29 | 198 | 6742888 | C | ADDITIVE | 0.0348988 | 0.88 |
| KLHL29 | 199 | 7564616 | G | ADDITIVE | 0.0438533 | 0.88 |
| KLHL29 | 200 | 893430 | G | ADDITIVE | 0.0328464 | 0.92 |
| KLHL29 | 201 | 747345 | A | ADDITIVE | 0.0428263 | 0.90 |
| KLHL29 | 202 | 737565 | A | ADDITIVE | 0.0321218 | 0.93 |
| KLHL29 | 203 | 747344 | G | ADDITIVE | 0.0405452 | 0.93 |
| KLHL29 | 204 | 6726802 | A | ADDITIVE | 0.0093161 | 0.86 |
| KLHL29 | 205 | 7573494 | G | ADDITIVE | 0.0330346 | 0.91 |
| KLHL29 | 206 | 7570872 | G | ADDITIVE | 0.0110811 | 0.87 |
| KLHL29 | 207 | 6544857 | C | ADDITIVE | 0.0109959 | 0.86 |
| KLHL29 | 208 | 10178369 | A | RECESSIVE | 0.0078072 | 0.59 |
| KLHL29 | 209 | 11125053 | G | RECESSIVE | 0.0431439 | 0.75 |
| ASXL2 | 211 | 7599961 | C | DOMINANT | 0.0448173 | 1.19 |
| ASXL2 | 212 | 12987707 | A | DOMINANT | 0.0494199 | 1.21 |
| CIB4 | 213 | 11694917 | T | RECESSIVE | 0.0346178 | 7.09 |
| BRE | 219 | 10168171 | A | DOMINANT | 0.0052977 | 0.77 |
| BRE | 220 | 10180107 | T | DOMINANT | 0.0028722 | 0.76 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| BRE | 221 | 6738887 | C | ADDITIVE | 0.0484749 | 0.89 |
| BRE | 222 | 12617913 | C | DOMINANT | 0.0403340 | 0.83 |
| CRIM1 | 231 | 848532 | C | ADDITIVE | 0.0300993 | 1.10 |
| CRIM1 | 232 | 848531 | A | ADDITIVE | 0.0304785 | 1.10 |
| CRIM1 | 236 | 3755197 | A | RECESSIVE | 0.0362269 | 1.33 |
| PLEKHH2 | 258 | 6753626 | T | DOMINANT | 0.0468983 | 0.80 |
| PLEKHH2 | 259 | 7570252 | A | DOMINANT | 0.0433193 | 0.84 |
| PLEKHH2 | 260 | 10165660 | C | DOMINANT | 0.0058234 | 0.79 |
| C2ORF34 | 265 | 1067343 | A | RECESSIVE | 0.0337422 | 1.46 |
| C2ORF34 | 269 | 1067378 | A | RECESSIVE | 0.0419640 | 1.44 |
| C2ORF34 | 270 | 1067375 | C | RECESSIVE | 0.0332333 | 1.47 |
| C2ORF34 | 271 | 1067374 | G | RECESSIVE | 0.0414616 | 1.45 |
| C2ORF34 | 276 | 1067348 | T | RECESSIVE | 0.0405977 | 1.49 |
| C2ORF34 | 280 | 1067402 | T | RECESSIVE | 0.0311285 | 1.52 |
| C2ORF34 | 282 | 698792 | A | RECESSIVE | 0.0404097 | 1.50 |
| C2ORF34 | 284 | 698793 | C | RECESSIVE | 0.0497570 | 1.41 |
| C2ORF34 | 299 | 1377906 | G | RECESSIVE | 0.0180084 | 1.38 |
| C2ORF34 | 300 | 7609431 | C | RECESSIVE | 0.0101792 | 1.41 |
| C2ORF34 | 301 | 4953101 | T | RECESSIVE | 0.0476874 | 1.32 |
| C2ORF34 | 302 | 10188972 | T | RECESSIVE | 0.0489810 | 1.31 |
| PRKCE | 309 | 4953294 | A | ADDITIVE | 0.0493338 | 1.10 |
| EPAS1 | 313 | 13006131 | G | RECESSIVE | 0.0402451 | 0.81 |
| PSME4 | 314 | 805316 | C | RECESSIVE | 0.0400115 | 1.40 |
| ACYP2 | 315 | 10186140 | C | RECESSIVE | 0.0264937 | 0.21 |
| CCDC85A | 316 | 13432055 | C | RECESSIVE | 0.0100911 | 1.50 |
| COMMD1 | 317 | 11885927 | A | RECESSIVE | 0.0241086 | 0.41 |
| AAK1 | 322 | 4852272 | T | DOMINANT | 0.0303217 | 0.83 |
| AAK1 | 323 | 2312213 | G | DOMINANT | 0.0460414 | 0.84 |
| AAK1 | 324 | 3821277 | G | DOMINANT | 0.0377504 | 0.83 |
| AAK1 | 325 | 4852868 | T | DOMINANT | 0.0488927 | 0.84 |
| AAK1 | 326 | 6736776 | T | RECESSIVE | 0.0027341 | 0.61 |
| CTNNA2 | 328 | 3795994 | A | RECESSIVE | 0.0330763 | 1.28 |
| CTNNA2 | 329 | 4541274 | C | RECESSIVE | 0.0476626 | 1.28 |
| NAP5 | 346 | 12478698 | C | DOMINANT | 0.0005561 | 0.74 |
| NAP5 | 349 | 7559118 | C | RECESSIVE | 0.0229795 | 1.70 |
| RAB3GAP1 | 354 | 2305594 | G | ADDITIVE | 0.0430480 | 0.81 |
| LRP1B | 359 | 2171169 | A | ADDITIVE | 0.0158790 | 0.83 |
| LRP1B | 360 | 3749010 | T | ADDITIVE | 0.0126393 | 0.78 |
| LRP1B | 361 | 12691587 | A | RECESSIVE | 0.0082097 | 1.35 |
| LRP1B | 362 | 1525600 | T | RECESSIVE | 0.0231176 | 1.30 |
| LRP1B | 363 | 1525598 | A | RECESSIVE | 0.0217906 | 1.30 |
| LRP1B | 365 | 352973 | A | DOMINANT | 0.0320322 | 0.83 |
| LRP1B | 371 | 2029142 | A | DOMINANT | 0.0001309 | 0.70 |
| LRP1B | 372 | 4662370 | T | DOMINANT | 0.0232464 | 0.82 |
| LRP1B | 373 | 1900933 | A | DOMINANT | 0.0011840 | 0.73 |
| LRP1B | 374 | 10928134 | C | DOMINANT | 0.0174066 | 0.81 |
| LRP1B | 375 | 7558803 | A | DOMINANT | 0.0005023 | 0.71 |
| LRP1B | 376 | 1449478 | C | DOMINANT | 0.0005212 | 0.71 |
| LRP1B | 377 | 13418304 | A | DOMINANT | 0.0299440 | 0.78 |
| LRP1B | 378 | 11680286 | A | DOMINANT | 0.0001878 | 0.69 |
| LRP1B | 379 | 1375613 | T | RECESSIVE | 0.0098351 | 1.30 |
| LRP1B | 380 | 12691633 | T | DOMINANT | 0.0117205 | 0.76 |
| LRP1B | 381 | 2290140 | T | DOMINANT | 0.0082539 | 0.79 |
| KYNU | 383 | 351685 | C | RECESSIVE | 0.0264489 | 2.52 |
| KYNU | 384 | 352892 | T | RECESSIVE | 0.0349849 | 0.76 |
| ARHGAP15 | 385 | 11681284 | C | RECESSIVE | 0.0329951 | 0.74 |
| ARHGAP15 | 386 | 6732131 | A | RECESSIVE | 0.0062475 | 0.68 |
| ARHGAP15 | 387 | 11694505 | G | RECESSIVE | 0.0058840 | 0.62 |
| ARHGAP15 | 388 | 6745691 | G | RECESSIVE | 0.0040745 | 0.67 |
| ARHGAP15 | 389 | 6750323 | C | RECESSIVE | 0.0031136 | 0.67 |
| ARHGAP15 | 390 | 4662343 | A | RECESSIVE | 0.0145068 | 0.72 |
| ARHGAP15 | 391 | 16823036 | A | DOMINANT | 0.0392608 | 1.20 |
| ARHGAP15 | 392 | 16823114 | A | DOMINANT | 0.0470151 | 1.19 |
| ARHGAP15 | 393 | 10928200 | T | DOMINANT | 0.0406542 | 1.20 |
| KCNJ3 | 399 | 12995382 | C | DOMINANT | 0.0487689 | 1.19 |
| PKP4 | 400 | 6437186 | T | DOMINANT | 0.0342404 | 7.11 |
| PKP4 | 401 | 2528575 | A | DOMINANT | 0.0403036 | 1.20 |
| PLA2R1 | 402 | 6432570 | T | DOMINANT | 0.0103076 | 0.78 |
| PLA2R1 | 403 | 3828324 | C | DOMINANT | 0.0296821 | 0.81 |
| SCN3A | 411 | 17829626 | A | DOMINANT | 0.0403437 | 0.61 |
| SCN2A | 413 | 4667810 | G | DOMINANT | 0.0020017 | 1.32 |
| SCN2A | 414 | 4667485 | C | DOMINANT | 0.0035559 | 1.31 |
| SCN2A | 415 | 10181853 | T | DOMINANT | 0.0019952 | 1.32 |
| SCN1A | 416 | 1824551 | C | RECESSIVE | 0.0282465 | 0.75 |
| SCN1A | 417 | 1841549 | C | RECESSIVE | 0.0321010 | 0.64 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| SCN1A | 418 | 7607543 | C | RECESSIVE | 0.0339116 | 0.65 |
| SCN1A | 419 | 1461197 | A | RECESSIVE | 0.0386158 | 0.76 |
| SCN1A | 420 | 1824549 | G | RECESSIVE | 0.0283570 | 0.75 |
| SCN1A | 421 | 1381105 | G | RECESSIVE | 0.0314593 | 0.75 |
| SCN9A | 422 | 4303728 | A | RECESSIVE | 0.0169081 | 0.19 |
| SCN7A | 426 | 3579 | A | DOMINANT | 0.0076308 | 0.74 |
| SCN7A | 427 | 13397124 | T | DOMINANT | 0.0155437 | 0.80 |
| SCN7A | 428 | 13029092 | T | DOMINANT | 0.0027898 | 0.74 |
| SCN7A | 429 | 13017982 | C | DOMINANT | 0.0021760 | 0.74 |
| SCN7A | 430 | 13022308 | A | DOMINANT | 0.0235060 | 0.80 |
| SCN7A | 431 | 2593529 | C | DOMINANT | 0.0036914 | 0.75 |
| PDE1A | 433 | 12693301 | G | DOMINANT | 0.0027198 | 0.77 |
| PDE1A | 434 | 12988258 | A | DOMINANT | 0.0169140 | 0.81 |
| PDE1A | 435 | 6736414 | T | DOMINANT | 0.0018837 | 0.76 |
| PDE1A | 436 | 6718589 | T | DOMINANT | 0.0079529 | 0.79 |
| PDE1A | 437 | 6719036 | A | DOMINANT | 0.0017120 | 0.75 |
| PDE1A | 439 | 1430158 | C | RECESSIVE | 0.0462373 | 0.74 |
| NAB1 | 441 | 16832766 | A | RECESSIVE | 0.0084389 | <.2 |
| TMEFF2 | 442 | 10497725 | C | DOMINANT | 0.0468195 | 1.19 |
| TMEFF2 | 443 | 13004835 | G | RECESSIVE | 0.0187116 | 1.26 |
| TMEFF2 | 444 | 17433337 | A | DOMINANT | 0.0138373 | 0.79 |
| PARD3B | 450 | 1861763 | C | RECESSIVE | 0.0402838 | 0.55 |
| PARD3B | 451 | 1019357 | G | RECESSIVE | 0.0103151 | 0.45 |
| PARD3B | 452 | 236843 | G | DOMINANT | 0.0273232 | 1.23 |
| NRP2 | 457 | 849565 | C | RECESSIVE | 0.0031073 | 1.92 |
| PIP5K3 | 458 | 6746926 | A | DOMINANT | 0.0076853 | 1.28 |
| ERBB4 | 459 | 12992319 | A | DOMINANT | 0.0400316 | 0.84 |
| IRS1 | 462 | 2288587 | C | DOMINANT | 0.0077855 | 0.67 |
| IRS1 | 463 | 16822570 | G | DOMINANT | 0.0077855 | 0.67 |
| IRS1 | 464 | 16822574 | T | ADDITIVE | 0.0429294 | 0.75 |
| IRS1 | 465 | 10205233 | T | ADDITIVE | 0.0131742 | 0.69 |
| IRS1 | 466 | 10181778 | T | ADDITIVE | 0.0014551 | 0.63 |
| IRS1 | 467 | 13414359 | G | RECESSIVE | 0.0185113 | 0.25 |
| IRS1 | 468 | 2396427 | G | RECESSIVE | 0.0434814 | 0.29 |
| COL4A4 | 469 | 1054413 | A | DOMINANT | 0.0093344 | 0.79 |
| COL4A4 | 470 | 10187726 | T | RECESSIVE | 0.0499004 | 1.22 |
| COL4A4 | 471 | 4423583 | T | DOMINANT | 0.0104595 | 0.79 |
| COL4A4 | 472 | 10182307 | A | DOMINANT | 0.0101423 | 0.79 |
| COL4A4 | 473 | 10933165 | G | DOMINANT | 0.0159812 | 0.80 |
| COL4A4 | 474 | 6740108 | C | DOMINANT | 0.0084746 | 0.78 |
| COL4A4 | 475 | 1949807 | G | DOMINANT | 0.0039806 | 0.77 |
| COL4A4 | 476 | 2272198 | T | DOMINANT | 0.0088794 | 0.79 |
| COL4A4 | 477 | 10176882 | T | DOMINANT | 0.0153786 | 0.80 |
| COL4A4 | 478 | 13423714 | G | DOMINANT | 0.0109821 | 0.79 |
| COL4A4 | 479 | 2276593 | A | DOMINANT | 0.0121443 | 0.79 |
| COL4A4 | 480 | 10166736 | A | DOMINANT | 0.0102444 | 0.79 |
| COL4A4 | 481 | 13383070 | A | DOMINANT | 0.0046153 | 0.77 |
| COL4A3 | 483 | 6436672 | A | DOMINANT | 0.0484551 | 1.26 |
| COL4A3 | 484 | 4673188 | T | DOMINANT | 0.0419728 | 1.25 |
| COL4A3 | 485 | 6436674 | A | DOMINANT | 0.0221612 | 1.31 |
| COL4A3 | 486 | 7587228 | C | DOMINANT | 0.0347568 | 1.26 |
| COL4A3 | 487 | 10188531 | C | DOMINANT | 0.0221612 | 1.31 |
| DNER | 488 | 207671 | G | RECESSIVE | 0.0221000 | 1.27 |
| DNER | 490 | 7584721 | A | DOMINANT | 0.0306237 | 1.29 |
| DNER | 491 | 10170426 | T | DOMINANT | 0.0179298 | 1.30 |
| DNER | 492 | 11695348 | A | DOMINANT | 0.0208254 | 1.32 |
| ECEL1 | 493 | 2678505 | G | RECESSIVE | 0.0264454 | 0.21 |
| SAG | 495 | 13427703 | G | DOMINANT | 0.0220575 | 0.78 |
| CENTG2 | 499 | 1962550 | G | ADDITIVE | 0.0450037 | 0.89 |
| CNTN6 | 501 | 9840388 | C | RECESSIVE | 0.0244837 | 0.79 |
| CNTN6 | 506 | 3772274 | T | ADDITIVE | 0.0304668 | 1.20 |
| CNTN6 | 508 | 2291101 | T | ADDITIVE | 0.0416503 | 1.15 |
| CNTN6 | 509 | 2291100 | C | ADDITIVE | 0.0003121 | 0.85 |
| CNTN6 | 510 | 17038463 | G | DOMINANT | 0.0381322 | 1.36 |
| CNTN6 | 511 | 3845158 | T | DOMINANT | 0.0285379 | 1.21 |
| CNTN6 | 512 | 3816445 | G | DOMINANT | 0.0364712 | 1.23 |
| CNTN4 | 513 | 11129148 | T | ADDITIVE | 0.0247728 | 0.89 |
| CNTN4 | 514 | 2134356 | C | ADDITIVE | 0.0101235 | 0.88 |
| CNTN4 | 515 | 899540 | G | DOMINANT | 0.0002858 | 1.42 |
| CNTN4 | 516 | 2616585 | T | DOMINANT | 0.0103108 | 1.27 |
| CNTN4 | 517 | 9837469 | G | DOMINANT | 0.0287880 | 0.81 |
| CNTN4 | 520 | 4685542 | C | ADDITIVE | 0.0499516 | 1.15 |
| CNTN4 | 521 | 9837045 | A | DOMINANT | 0.0224299 | 1.24 |
| CNTN4 | 522 | 9843087 | T | DOMINANT | 0.0407710 | 1.20 |
| ITPR1 | 526 | 304014 | A | DOMINANT | 0.0460660 | 0.84 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| ITPR1 | 527 | 13080068 | A | RECESSIVE | 0.0234785 | <.2 |
| ITPR1 | 528 | 902985 | C | RECESSIVE | 0.0389873 | <.2 |
| ITPR1 | 529 | 9818111 | A | RECESSIVE | 0.0236952 | <.2 |
| ITPR1 | 530 | 3792489 | A | RECESSIVE | 0.0339749 | 0.74 |
| IRAK2 | 532 | 778041 | A | ADDITIVE | 0.0238947 | 1.14 |
| IRAK2 | 533 | 708035 | T | ADDITIVE | 0.0196761 | 1.14 |
| SLC6A11 | 535 | 1485142 | C | RECESSIVE | 0.0092762 | 0.53 |
| SLC6A1 | 536 | 1062246 | G | DOMINANT | 0.0301978 | 0.83 |
| SLC6A6 | 537 | 11713355 | A | DOMINANT | 0.0495407 | 0.84 |
| FBXL2 | 539 | 9880596 | C | DOMINANT | 0.0014283 | 1.32 |
| CLASP2 | 540 | 4679039 | C | RECESSIVE | 0.0114555 | 0.72 |
| CLASP2 | 541 | 6772776 | T | RECESSIVE | 0.0498543 | 0.78 |
| CLASP2 | 542 | 8179967 | C | ADDITIVE | 0.0147798 | 0.87 |
| CLASP2 | 543 | 6807542 | G | ADDITIVE | 0.0266431 | 0.90 |
| ULK4 | 553 | 2293301 | G | RECESSIVE | 0.0428999 | 3.55 |
| ULK4 | 554 | 2293300 | C | RECESSIVE | 0.0248408 | 3.94 |
| ULK4 | 555 | 9838277 | G | RECESSIVE | 0.0430861 | 3.55 |
| ULK4 | 556 | 12493870 | C | RECESSIVE | 0.0430861 | 3.55 |
| ULK4 | 557 | 9820239 | T | RECESSIVE | 0.0397738 | 1.52 |
| ULK4 | 559 | 1386601 | G | RECESSIVE | 0.0459956 | 1.26 |
| ULK4 | 560 | 9832048 | A | RECESSIVE | 0.0411133 | 1.23 |
| ZNF445 | 561 | 9311357 | G | RECESSIVE | 0.0462402 | 1.33 |
| CAMKV | 564 | 2883059 | C | RECESSIVE | 0.0170760 | 1.32 |
| SEMA3F | 565 | 2624842 | G | RECESSIVE | 0.0015687 | 2.76 |
| SEMA3F | 566 | 11711407 | A | RECESSIVE | 0.0018287 | 1.39 |
| CACNA2D2 | 567 | 762895 | C | RECESSIVE | 0.0018308 | 2.65 |
| CACNA2D2 | 568 | 2298955 | C | RECESSIVE | 0.0013825 | 2.64 |
| CACNA2D2 | 569 | 734767 | C | RECESSIVE | 0.0012152 | 2.67 |
| CACNA2D2 | 570 | 2236964 | G | RECESSIVE | 0.0073441 | 2.31 |
| CACNA2D2 | 571 | 916217 | T | RECESSIVE | 0.0100097 | 2.30 |
| CACNA2D2 | 572 | 2236967 | A | RECESSIVE | 0.0236960 | 2.06 |
| CACNA2D2 | 573 | 743757 | G | RECESSIVE | 0.0048367 | 2.39 |
| CACNA2D2 | 574 | 2236975 | C | RECESSIVE | 0.0043747 | 2.48 |
| CACNA2D2 | 575 | 12492113 | A | RECESSIVE | 0.0077768 | 2.49 |
| CACNA2D2 | 576 | 6786523 | T | RECESSIVE | 0.0003940 | 3.05 |
| CACNA2D2 | 577 | 12494849 | G | RECESSIVE | 0.0003948 | 3.05 |
| CACNA2D2 | 578 | 1467913 | T | RECESSIVE | 0.0003948 | 3.05 |
| CACNA2D2 | 579 | 754298 | C | RECESSIVE | 0.0304486 | 2.10 |
| ERC2 | 587 | 11712729 | C | RECESSIVE | 0.0260858 | 1.43 |
| FHIT | 591 | 11707783 | G | ADDITIVE | 0.0482246 | 0.82 |
| FHIT | 592 | 6446100 | T | DOMINANT | 0.0035376 | 0.77 |
| FHIT | 593 | 2736802 | A | DOMINANT | 0.0392613 | 0.81 |
| FHIT | 594 | 212015 | T | ADDITIVE | 0.0203327 | 0.81 |
| FHIT | 595 | 13066381 | T | DOMINANT | 0.0083825 | 0.80 |
| FHIT | 596 | 802778 | A | ADDITIVE | 0.0214893 | 0.80 |
| FHIT | 597 | 802779 | C | ADDITIVE | 0.0432879 | 0.82 |
| FHIT | 598 | 17062392 | C | DOMINANT | 0.0186053 | 1.23 |
| FHIT | 601 | 7650786 | T | RECESSIVE | 0.0483484 | 1.24 |
| FHIT | 602 | 2142296 | G | ADDITIVE | 0.0252880 | 0.88 |
| PTPRG | 603 | 1388613 | C | RECESSIVE | 0.0291650 | 0.66 |
| CADPS | 604 | 304209 | G | DOMINANT | 0.0406227 | 0.84 |
| SYNPR | 612 | 1812207 | A | DOMINANT | 0.0082602 | 1.26 |
| SYNPR | 613 | 1505595 | A | RECESSIVE | 0.0459095 | 1.58 |
| ROBO2 | 624 | 4683968 | G | DOMINANT | 0.0446194 | 1.20 |
| ROBO1 | 626 | 329812 | C | RECESSIVE | 0.0164134 | 1.39 |
| ROBO1 | 627 | 162262 | T | RECESSIVE | 0.0084565 | 1.43 |
| ROBO1 | 628 | 1455833 | A | RECESSIVE | 0.0493273 | 0.73 |
| ROBO1 | 629 | 7631406 | T | RECESSIVE | 0.0109668 | 0.68 |
| ROBO1 | 630 | 12486635 | G | RECESSIVE | 0.0408876 | 0.75 |
| GBE1 | 632 | 9821673 | A | RECESSIVE | 0.0292191 | 0.60 |
| CBLB | 635 | 1443108 | T | RECESSIVE | 0.0351240 | 0.71 |
| CBLB | 636 | 1550711 | G | RECESSIVE | 0.0404819 | 0.79 |
| CBLB | 637 | 7638504 | C | DOMINANT | 0.0101111 | 0.77 |
| CBLB | 638 | 12497428 | G | DOMINANT | 0.0135723 | 0.77 |
| CBLB | 639 | 9838755 | C | DOMINANT | 0.0122254 | 0.77 |
| KALRN | 644 | 13321072 | C | DOMINANT | 0.0396312 | 0.78 |
| KALRN | 645 | 2008839 | A | DOMINANT | 0.0354175 | 0.77 |
| KALRN | 646 | 1822995 | A | ADDITIVE | 0.0345649 | 1.24 |
| KALRN | 647 | 10433406 | A | ADDITIVE | 0.0211886 | 1.24 |
| KALRN | 648 | 2289843 | A | ADDITIVE | 0.0148873 | 1.26 |
| KALRN | 649 | 3729581 | T | DOMINANT | 0.0351293 | 1.23 |
| ZXDC | 651 | 1043803 | A | DOMINANT | 0.0333425 | 0.83 |
| ZXDC | 652 | 1687462 | C | DOMINANT | 0.0266341 | 0.82 |
| CPNE4 | 654 | 9289393 | T | RECESSIVE | 0.0302037 | 1.26 |
| CPNE4 | 655 | 16838031 | A | ADDITIVE | 0.0008895 | 1.44 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| CPNE4 | 656 | 17297521 | G | DOMINANT | 0.0130424 | 1.30 |
| CPNE4 | 657 | 6806898 | T | ADDITIVE | 0.0109104 | 1.26 |
| EPHB1 | 671 | 3772637 | T | DOMINANT | 0.0037323 | 1.28 |
| SPSB4 | 672 | 9816809 | T | DOMINANT | 0.0476394 | 1.26 |
| SPSB4 | 673 | 11915229 | C | DOMINANT | 0.0496640 | 1.26 |
| SERPINI1 | 675 | 2229697 | A | DOMINANT | 0.0434861 | 0.80 |
| SLC7A14 | 676 | 7648588 | A | DOMINANT | 0.0475929 | 0.83 |
| TNIK | 681 | 6445006 | A | RECESSIVE | 0.0017287 | 0.52 |
| PLD1 | 682 | 380929 | A | ADDITIVE | 0.0362956 | 1.11 |
| PLD1 | 683 | 397176 | T | ADDITIVE | 0.0318479 | 1.12 |
| PLD1 | 684 | 431196 | C | ADDITIVE | 0.0322453 | 1.12 |
| PLD1 | 685 | 406484 | A | ADDITIVE | 0.0339780 | 1.11 |
| PLD1 | 686 | 405910 | T | ADDITIVE | 0.0195401 | 1.11 |
| PLD1 | 687 | 360413 | A | ADDITIVE | 0.0143963 | 1.15 |
| PLD1 | 688 | 187229 | T | ADDITIVE | 0.0118656 | 1.17 |
| PLD1 | 689 | 181715 | A | ADDITIVE | 0.0093281 | 1.19 |
| PLD1 | 690 | 360401 | T | ADDITIVE | 0.0114614 | 1.18 |
| NLGN1 | 703 | 6779415 | A | DOMINANT | 0.0412066 | 1.22 |
| NLGN1 | 705 | 9815572 | A | ADDITIVE | 0.0466970 | 1.17 |
| NLGN1 | 706 | 7614469 | C | RECESSIVE | 0.0177892 | 1.62 |
| IL1RAP | 710 | 4140708 | G | RECESSIVE | 0.0320163 | 1.40 |
| IL1RAP | 711 | 3774001 | G | RECESSIVE | 0.0214074 | 1.44 |
| IL1RAP | 712 | 3773999 | C | RECESSIVE | 0.0175931 | 1.45 |
| IL1RAP | 713 | 9990231 | C | RECESSIVE | 0.0048588 | 1.61 |
| IL1RAP | 714 | 10212103 | C | RECESSIVE | 0.0173303 | 1.46 |
| IL1RAP | 716 | 10513860 | A | RECESSIVE | 0.0307056 | 4.72 |
| IL1RAP | 717 | 6444452 | T | RECESSIVE | 0.0167183 | 5.33 |
| CENTB2 | 718 | 2410839 | G | DOMINANT | 0.0200194 | 1.24 |
| SLC2A9 | 721 | 13142273 | T | RECESSIVE | 0.0300284 | >5 |
| SLC2A9 | 722 | 3733589 | T | RECESSIVE | 0.0300284 | >5 |
| SLC2A9 | 723 | 16891926 | T | RECESSIVE | 0.0291182 | >5 |
| SLC2A9 | 724 | 13101772 | A | RECESSIVE | 0.0300161 | >5 |
| LDB2 | 726 | 1501132 | T | RECESSIVE | 0.0003835 | 0.33 |
| LDB2 | 727 | 6449255 | A | RECESSIVE | 0.0174593 | 0.55 |
| LDB2 | 728 | 1501141 | T | RECESSIVE | 0.0285595 | 0.57 |
| SOD3 | 740 | 12649653 | A | RECESSIVE | 0.0401569 | 0.73 |
| PI4K2B | 741 | 7654358 | G | RECESSIVE | 0.0424119 | 1.27 |
| N4BP2 | 745 | 1625495 | C | RECESSIVE | 0.0459815 | 0.56 |
| LIMCH1 | 754 | 4610372 | G | DOMINANT | 0.0063646 | 1.29 |
| LIMCH1 | 756 | 4861118 | A | DOMINANT | 0.0464618 | 1.20 |
| LIMCH1 | 759 | 1105886 | T | DOMINANT | 0.0081667 | 1.26 |
| LIMCH1 | 760 | 10026359 | T | DOMINANT | 0.0006576 | 1.37 |
| LIMCH1 | 761 | 13146318 | T | DOMINANT | 0.0093573 | 1.25 |
| LIMCH1 | 762 | 10805090 | C | DOMINANT | 0.0115515 | 1.24 |
| LIMCH1 | 763 | 13113314 | T | DOMINANT | 0.0122260 | 1.27 |
| LIMCH1 | 764 | 2304651 | A | RECESSIVE | 0.0225626 | 0.13 |
| LIMCH1 | 765 | 7674006 | C | RECESSIVE | 0.0388071 | <.2 |
| LPHN3 | 768 | 950313 | C | RECESSIVE | 0.0124420 | 0.53 |
| LPHN3 | 769 | 1124974 | A | RECESSIVE | 0.0449070 | 0.62 |
| NPFFR2 | 772 | 4574375 | G | ADDITIVE | 0.0358307 | 0.66 |
| NPFFR2 | 773 | 4379029 | G | ADDITIVE | 0.0361672 | 0.66 |
| NPFFR2 | 774 | 7657617 | A | ADDITIVE | 0.0498153 | 0.68 |
| NPFFR2 | 775 | 4276256 | T | ADDITIVE | 0.0490012 | 0.68 |
| NPFFR2 | 776 | 9884712 | A | ADDITIVE | 0.0369620 | 0.66 |
| NPFFR2 | 777 | 10938003 | A | ADDITIVE | 0.0362230 | 0.66 |
| NPFFR2 | 778 | 10033980 | C | ADDITIVE | 0.0358307 | 0.66 |
| NPFFR2 | 779 | 4472109 | T | ADDITIVE | 0.0186600 | 0.62 |
| NPFFR2 | 780 | 11733404 | A | ADDITIVE | 0.0183936 | 1.15 |
| NPFFR2 | 781 | 2137735 | A | DOMINANT | 0.0086958 | 1.25 |
| NPFFR2 | 782 | 7673208 | C | ADDITIVE | 0.0054932 | 1.18 |
| NPFFR2 | 783 | 2365797 | T | ADDITIVE | 0.0207231 | 1.13 |
| SCARB2 | 784 | 17001532 | A | RECESSIVE | 0.0073559 | 2.31 |
| SCARB2 | 785 | 17001533 | C | RECESSIVE | 0.0073559 | 2.31 |
| SCD5 | 790 | 10014168 | C | RECESSIVE | 0.0137208 | 1.48 |
| GPRIN3 | 791 | 6844815 | G | RECESSIVE | 0.0344083 | 0.77 |
| GPRIN3 | 794 | 12498405 | T | RECESSIVE | 0.0326299 | 1.25 |
| GPRIN3 | 795 | 6839114 | C | RECESSIVE | 0.0318186 | 1.25 |
| GRID2 | 796 | 1993030 | T | RECESSIVE | 0.0084799 | 0.60 |
| UNC5C | 811 | 2220105 | G | RECESSIVE | 0.0256000 | 1.40 |
| UNC5C | 814 | 13121737 | C | DOMINANT | 0.0140151 | 0.80 |
| UNC5C | 815 | 13134684 | T | ADDITIVE | 0.0299021 | 0.90 |
| UNC5C | 816 | 4103379 | G | DOMINANT | 0.0193420 | 0.80 |
| UNC5C | 817 | 6834411 | G | DOMINANT | 0.0202948 | 0.80 |
| UNC5C | 818 | 4519799 | G | RECESSIVE | 0.0304882 | 4.73 |
| ADH1C | 820 | 2851255 | G | RECESSIVE | 0.0281527 | 0.69 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| PPP3CA | 826 | 2659524 | A | RECESSIVE | 0.0464225 | 0.64 |
| PAPSS1 | 827 | 9569 | A | RECESSIVE | 0.0327436 | 0.66 |
| PAPSS1 | 828 | 2522421 | G | RECESSIVE | 0.0138444 | 0.12 |
| PAPSS1 | 829 | 2522422 | A | RECESSIVE | 0.0139557 | 0.12 |
| PAPSS1 | 830 | 2522423 | T | RECESSIVE | 0.0088063 | 0.11 |
| PAPSS1 | 831 | 757170 | T | RECESSIVE | 0.0225406 | 0.13 |
| PAPSS1 | 832 | 2726198 | G | RECESSIVE | 0.0141927 | 0.12 |
| PAPSS1 | 833 | 2340454 | T | RECESSIVE | 0.0034834 | <.2 |
| PAPSS1 | 834 | 2522431 | C | RECESSIVE | 0.0139557 | 0.12 |
| COL25A1 | 838 | 17233629 | A | DOMINANT | 0.0208133 | 1.22 |
| COL25A1 | 839 | 4256292 | G | DOMINANT | 0.0276724 | 1.21 |
| COL25A1 | 840 | 6857726 | A | ADDITIVE | 0.0281793 | 1.19 |
| ANK2 | 843 | 10488905 | C | DOMINANT | 0.0194020 | 1.25 |
| ANK2 | 844 | 11933707 | G | DOMINANT | 0.0068063 | 1.27 |
| ANK2 | 845 | 10488904 | A | DOMINANT | 0.0098931 | 1.26 |
| ANK2 | 847 | 29355 | G | RECESSIVE | 0.0087407 | 0.32 |
| ANK2 | 848 | 29319 | A | RECESSIVE | 0.0059700 | 0.30 |
| CAMK2D | 850 | 13144613 | G | RECESSIVE | 0.0478159 | 1.30 |
| MAML3 | 856 | 1350036 | T | DOMINANT | 0.0438195 | 1.22 |
| MAML3 | 857 | 2604918 | A | DOMINANT | 0.0139465 | 0.81 |
| MAML3 | 858 | 7698089 | T | RECESSIVE | 0.0079339 | 1.32 |
| MAML3 | 859 | 7656823 | A | RECESSIVE | 0.0089806 | 1.31 |
| MAML3 | 860 | 9996478 | G | RECESSIVE | 0.0093113 | 1.31 |
| MAML3 | 861 | 4863720 | C | RECESSIVE | 0.0079848 | 1.32 |
| MAML3 | 863 | 6858531 | T | RECESSIVE | 0.0498930 | 2.55 |
| MAML3 | 864 | 11947536 | C | RECESSIVE | 0.0078938 | >5 |
| INPP4B | 866 | 336407 | G | ADDITIVE | 0.0099862 | 1.17 |
| INPP4B | 867 | 336402 | T | DOMINANT | 0.0127092 | 1.25 |
| INPP4B | 868 | 336406 | A | DOMINANT | 0.0083762 | 1.27 |
| INPP4B | 869 | 336394 | G | DOMINANT | 0.0047041 | 1.29 |
| INPP4B | 870 | 2636637 | T | DOMINANT | 0.0115457 | 1.26 |
| INPP4B | 871 | 1219269 | T | DOMINANT | 0.0328045 | 1.22 |
| INPP4B | 872 | 2636656 | G | DOMINANT | 0.0493955 | 1.20 |
| INPP4B | 873 | 3102439 | G | DOMINANT | 0.0224570 | 1.24 |
| INPP4B | 874 | 1907119 | G | DOMINANT | 0.0186256 | 1.25 |
| INPP4B | 875 | 2172023 | T | DOMINANT | 0.0200937 | 1.24 |
| INPP4B | 876 | 2636652 | C | ADDITIVE | 0.0109982 | 1.26 |
| DCLK2 | 892 | 11727182 | G | DOMINANT | 0.0322952 | 0.82 |
| CTSO | 894 | 6832480 | T | DOMINANT | 0.0237369 | 1.22 |
| CTSO | 895 | 6536124 | T | DOMINANT | 0.0234800 | 1.22 |
| CTSO | 896 | 10024900 | A | ADDITIVE | 0.0325296 | 1.14 |
| FSTL5 | 904 | 7375994 | A | RECESSIVE | 0.0315844 | 1.69 |
| TLL1 | 910 | 12646597 | T | RECESSIVE | 0.0483031 | 0.79 |
| TLL1 | 911 | 10018177 | T | RECESSIVE | 0.0412312 | 0.75 |
| PALLD | 913 | 10440507 | T | DOMINANT | 0.0486089 | 0.84 |
| PALLD | 914 | 6552874 | A | RECESSIVE | 0.0462259 | 1.35 |
| PALLD | 915 | 10019193 | G | RECESSIVE | 0.0304723 | 1.38 |
| PALLD | 917 | 2710841 | T | DOMINANT | 0.0321971 | 0.83 |
| PALLD | 918 | 4280700 | T | DOMINANT | 0.0338394 | 0.81 |
| PALLD | 919 | 12511925 | T | DOMINANT | 0.0274824 | 0.81 |
| PALLD | 920 | 13122019 | A | RECESSIVE | 0.0407708 | 1.24 |
| PALLD | 921 | 1039386 | G | DOMINANT | 0.0385672 | 0.83 |
| GPM6A | 928 | 2877886 | C | DOMINANT | 0.0050323 | 0.78 |
| GPM6A | 929 | 1021226 | C | ADDITIVE | 0.0380585 | 0.92 |
| ENPP6 | 934 | 9968325 | A | ADDITIVE | 0.0406970 | 1.16 |
| CASP3 | 935 | 12108497 | T | DOMINANT | 0.0111860 | 1.24 |
| SLC6A3 | 936 | 27061 | A | ADDITIVE | 0.0167413 | 0.87 |
| SLC6A3 | 937 | 250682 | G | DOMINANT | 0.0065105 | 0.78 |
| SLC6A3 | 938 | 250681 | A | DOMINANT | 0.0470083 | 0.83 |
| SLC6A3 | 939 | 393795 | A | DOMINANT | 0.0025052 | 0.76 |
| SLC6A3 | 940 | 2937639 | A | RECESSIVE | 0.0240082 | 0.76 |
| SEMA5A | 941 | 1806095 | T | ADDITIVE | 0.0352291 | 1.23 |
| SEMA5A | 942 | 268529 | G | ADDITIVE | 0.0374797 | 1.11 |
| SEMA5A | 945 | 150631 | A | ADDITIVE | 0.0360142 | 0.87 |
| CTNND2 | 946 | 1024497 | A | ADDITIVE | 0.0281941 | 0.87 |
| CTNND2 | 947 | 13358276 | T | ADDITIVE | 0.0019458 | 1.19 |
| CTNND2 | 948 | 32267 | T | DOMINANT | 0.0124904 | 0.79 |
| CTNND2 | 949 | 32264 | T | DOMINANT | 0.0121132 | 0.79 |
| CTNND2 | 952 | 31888 | A | ADDITIVE | 0.0362142 | 0.84 |
| CTNND2 | 953 | 31892 | T | ADDITIVE | 0.0472033 | 0.87 |
| CTNND2 | 954 | 1458482 | T | DOMINANT | 0.0011190 | 1.35 |
| CTNND2 | 955 | 1458483 | T | ADDITIVE | 0.0014734 | 0.81 |
| CTNND2 | 956 | 6884647 | T | DOMINANT | 0.0010565 | 1.35 |
| CTNND2 | 957 | 1542428 | T | DOMINANT | 0.0004697 | 1.38 |
| CTNND2 | 958 | 1379901 | T | DOMINANT | 0.0007729 | 1.36 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| DNAH5 | 960 | 13154455 | G | RECESSIVE | 0.0417889 | 1.27 |
| DNAH5 | 961 | 13178616 | C | RECESSIVE | 0.0248029 | 1.32 |
| BASP1 | 964 | 2929726 | A | ADDITIVE | 0.0022115 | 1.16 |
| BASP1 | 965 | 2956564 | G | ADDITIVE | 0.0025794 | 1.13 |
| BASP1 | 966 | 2929710 | C | ADDITIVE | 0.0023921 | 1.13 |
| CDH10 | 968 | 10056470 | C | RECESSIVE | 0.0411944 | 0.50 |
| SLC1A3 | 974 | 2731877 | C | DOMINANT | 0.0461012 | 0.82 |
| SLC1A3 | 975 | 4869680 | G | DOMINANT | 0.0351844 | 0.83 |
| EGFLAM | 976 | 6873748 | C | RECESSIVE | 0.0284958 | 0.34 |
| EGFLAM | 977 | 2589804 | G | RECESSIVE | 0.0058548 | 0.32 |
| EGFLAM | 978 | 2561111 | T | RECESSIVE | 0.0497412 | 0.43 |
| ITGA1 | 979 | 2548494 | T | ADDITIVE | 0.0368558 | 1.19 |
| ITGA1 | 980 | 13189973 | T | ADDITIVE | 0.0394305 | 1.19 |
| ITGA1 | 983 | 10513000 | G | ADDITIVE | 0.0138472 | 0.89 |
| ITGA1 | 986 | 1047481 | G | DOMINANT | 0.0313913 | 1.22 |
| ITGA2 | 988 | 989073 | A | ADDITIVE | 0.0375827 | 1.12 |
| ITGA2 | 989 | 1421937 | C | ADDITIVE | 0.0317117 | 1.12 |
| ITGA2 | 994 | 12521915 | G | RECESSIVE | 0.0343584 | 1.32 |
| PDE4D | 997 | 12654005 | G | DOMINANT | 0.0381491 | 0.83 |
| PDE4D | 998 | 929820 | T | DOMINANT | 0.0479056 | 0.84 |
| PDE4D | 999 | 9292195 | T | ADDITIVE | 0.0404465 | 1.15 |
| PDE4D | 1000 | 35258 | T | RECESSIVE | 0.0398711 | 0.77 |
| PDE4D | 1001 | 294492 | T | RECESSIVE | 0.0080393 | 2.48 |
| PDE4D | 1002 | 295954 | G | RECESSIVE | 0.0337408 | 1.99 |
| PDE4D | 1003 | 295956 | T | RECESSIVE | 0.0222173 | 2.12 |
| PDE4D | 1004 | 17380508 | C | RECESSIVE | 0.0499867 | 0.43 |
| ELOVL7 | 1007 | 6449503 | A | DOMINANT | 0.0493368 | 0.83 |
| ELOVL7 | 1008 | 4482855 | T | DOMINANT | 0.0210430 | 0.80 |
| ELOVL7 | 1009 | 4700394 | A | DOMINANT | 0.0224171 | 0.80 |
| ELOVL7 | 1010 | 4700397 | A | RECESSIVE | 0.0271345 | 1.28 |
| ELOVL7 | 1011 | 17332824 | G | RECESSIVE | 0.0297118 | 1.27 |
| PIK3R1 | 1012 | 706713 | T | RECESSIVE | 0.0495010 | 0.66 |
| TNPO1 | 1015 | 34673 | G | DOMINANT | 0.0424093 | 0.81 |
| TNPO1 | 1016 | 155624 | T | ADDITIVE | 0.0188032 | 0.81 |
| FCHO2 | 1018 | 7712673 | T | ADDITIVE | 0.0260252 | 0.86 |
| FCHO2 | 1019 | 716327 | T | ADDITIVE | 0.0227187 | 0.85 |
| FCHO2 | 1020 | 1156398 | G | ADDITIVE | 0.0244766 | 0.85 |
| FCHO2 | 1021 | 1568712 | G | ADDITIVE | 0.0196452 | 0.85 |
| FCHO2 | 1022 | 2277017 | C | ADDITIVE | 0.0379745 | 0.87 |
| FCHO2 | 1023 | 7727222 | C | ADDITIVE | 0.0064707 | 0.83 |
| PDE8B | 1024 | 1982658 | A | RECESSIVE | 0.0095640 | 0.66 |
| PDE8B | 1025 | 11953611 | C | RECESSIVE | 0.0030521 | 1.64 |
| PDE8B | 1030 | 13178853 | C | RECESSIVE | 0.0344304 | 1.46 |
| PDE8B | 1031 | 398509 | G | RECESSIVE | 0.0406595 | 1.44 |
| PDE8B | 1032 | 335643 | G | RECESSIVE | 0.0073142 | 1.63 |
| SCAMP1 | 1034 | 10942850 | G | DOMINANT | 0.0484655 | 0.82 |
| SCAMP1 | 1035 | 1529497 | T | DOMINANT | 0.0144309 | 0.79 |
| SCAMP1 | 1036 | 11950060 | T | DOMINANT | 0.0146335 | 0.79 |
| SCAMP1 | 1037 | 11949403 | A | DOMINANT | 0.0191555 | 0.79 |
| SCAMP1 | 1038 | 3952231 | G | DOMINANT | 0.0105949 | 0.78 |
| SCAMP1 | 1039 | 9293749 | A | DOMINANT | 0.0144309 | 0.79 |
| SCAMP1 | 1040 | 10474548 | G | RECESSIVE | 0.0114317 | 1.29 |
| SCAMP1 | 1041 | 10065805 | C | DOMINANT | 0.0169067 | 0.79 |
| SCAMP1 | 1042 | 1050674 | G | DOMINANT | 0.0087343 | 0.77 |
| SCAMP1 | 1043 | 10514138 | G | DOMINANT | 0.0097017 | 0.77 |
| CMYA5 | 1050 | 12514461 | G | DOMINANT | 0.0467297 | 1.24 |
| MEF2C | 1052 | 454214 | G | ADDITIVE | 0.0081904 | 1.14 |
| MEF2C | 1053 | 618298 | T | ADDITIVE | 0.0161067 | 1.14 |
| MEF2C | 1054 | 625970 | A | ADDITIVE | 0.0147143 | 1.14 |
| MEF2C | 1055 | 681446 | A | ADDITIVE | 0.0103384 | 1.15 |
| MEF2C | 1056 | 679232 | G | ADDITIVE | 0.0126294 | 1.15 |
| MEF2C | 1057 | 304153 | T | DOMINANT | 0.0022371 | 1.30 |
| MEF2C | 1058 | 304152 | C | DOMINANT | 0.0026481 | 1.30 |
| MEF2C | 1059 | 304151 | C | DOMINANT | 0.0085504 | 1.25 |
| MEF2C | 1060 | 304159 | T | DOMINANT | 0.0021511 | 1.30 |
| GPR98 | 1063 | 7716829 | A | DOMINANT | 0.0390854 | 0.83 |
| GPR98 | 1067 | 1876635 | C | RECESSIVE | 0.0053294 | 0.21 |
| GPR98 | 1069 | 1852731 | C | ADDITIVE | 0.0462196 | 0.86 |
| PJA2 | 1086 | 2963046 | T | RECESSIVE | 0.0407637 | 1.29 |
| PJA2 | 1087 | 2914705 | A | RECESSIVE | 0.0380956 | 1.30 |
| PJA2 | 1089 | 2963029 | C | RECESSIVE | 0.0083230 | 1.44 |
| PJA2 | 1090 | 2963031 | A | RECESSIVE | 0.0215023 | 1.48 |
| PJA2 | 1091 | 2963034 | A | RECESSIVE | 0.0155698 | 1.40 |
| PJA2 | 1092 | 2963013 | C | RECESSIVE | 0.0065274 | 1.58 |
| KCNN2 | 1094 | 1841248 | G | RECESSIVE | 0.0051033 | 0.43 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| KCNN2 | 1095 | 6889371 | G | RECESSIVE | 0.0101849 | 0.45 |
| SEMA6A | 1096 | 154599 | G | RECESSIVE | 0.0337687 | 0.61 |
| SEMA6A | 1097 | 154600 | C | RECESSIVE | 0.0488880 | 0.64 |
| VDAC1 | 1110 | 2066944 | T | RECESSIVE | 0.0139245 | 0.51 |
| GRIA1 | 1133 | 1037892 | T | RECESSIVE | 0.0339369 | 0.68 |
| ODZ2 | 1134 | 5024074 | G | DOMINANT | 0.0015007 | 1.42 |
| ODZ2 | 1137 | 1549152 | C | DOMINANT | 0.0358324 | 0.81 |
| ODZ2 | 1138 | 9284975 | T | DOMINANT | 0.0430784 | 0.76 |
| ODZ2 | 1140 | 11952245 | G | DOMINANT | 0.0310791 | 0.83 |
| ODZ2 | 1141 | 11959012 | T | DOMINANT | 0.0200308 | 1.25 |
| ODZ2 | 1143 | 10447203 | A | ADDITIVE | 0.0114402 | 0.87 |
| ODZ2 | 1144 | 11748886 | G | ADDITIVE | 0.0306799 | 0.79 |
| WWC1 | 1146 | 9686714 | C | RECESSIVE | 0.0138956 | 0.12 |
| WWC1 | 1147 | 2085449 | A | ADDITIVE | 0.0147636 | 0.86 |
| WWC1 | 1150 | 888773 | A | ADDITIVE | 0.0147299 | 0.82 |
| KCNIP1 | 1154 | 4867625 | A | RECESSIVE | 0.0084345 | 1.79 |
| STK10 | 1157 | 2172048 | C | RECESSIVE | 0.0266094 | 1.27 |
| EXOC2 | 1162 | 9405242 | A | DOMINANT | 0.0286682 | 0.82 |
| EXOC2 | 1164 | 1766835 | C | RECESSIVE | 0.0130641 | 1.55 |
| EXOC2 | 1165 | 4960092 | G | RECESSIVE | 0.0171303 | 1.65 |
| EXOC2 | 1167 | 1747586 | A | RECESSIVE | 0.0472588 | 1.53 |
| EXOC2 | 1168 | 9328331 | G | RECESSIVE | 0.0476395 | 1.44 |
| JARID2 | 1174 | 2237156 | T | ADDITIVE | 0.0054397 | 1.24 |
| JARID2 | 1175 | 4109434 | T | ADDITIVE | 0.0061261 | 0.88 |
| JARID2 | 1176 | 9383054 | G | ADDITIVE | 0.0043356 | 1.25 |
| JARID2 | 1177 | 2237152 | G | DOMINANT | 0.0007130 | 1.36 |
| JARID2 | 1178 | 2237150 | G | DOMINANT | 0.0038437 | 1.30 |
| JARID2 | 1179 | 4085876 | T | ADDITIVE | 0.0016878 | 1.20 |
| JARID2 | 1180 | 2282827 | C | ADDITIVE | 0.0033568 | 1.17 |
| JARID2 | 1181 | 9476827 | T | ADDITIVE | 0.0010437 | 1.20 |
| JARID2 | 1182 | 2237124 | C | ADDITIVE | 0.0006731 | 1.22 |
| ATXN1 | 1183 | 235146 | C | RECESSIVE | 0.0194869 | 0.78 |
| ATXN1 | 1184 | 235147 | A | DOMINANT | 0.0015523 | 1.35 |
| ATXN1 | 1185 | 2237175 | C | DOMINANT | 0.0033516 | 0.70 |
| SLC17A4 | 1198 | 9358890 | G | DOMINANT | 0.0070529 | 0.66 |
| BTN3A1 | 1214 | 3799378 | G | RECESSIVE | 0.0343668 | 1.51 |
| MSH5 | 1217 | 2299851 | A | ADDITIVE | 0.0063621 | 1.35 |
| MSH5 | 1218 | 707937 | C | RECESSIVE | 0.0160747 | 1.82 |
| KLC4 | 1221 | 9471999 | C | RECESSIVE | 0.0279392 | 0.34 |
| TJAP1 | 1223 | 7755135 | T | DOMINANT | 0.0170193 | 1.30 |
| XPO5 | 1224 | 7769795 | A | ADDITIVE | 0.0440420 | 1.25 |
| XPO5 | 1225 | 7748977 | C | ADDITIVE | 0.0377733 | 1.26 |
| XPO5 | 1226 | 1096699 | A | RECESSIVE | 0.0342656 | 0.73 |
| XPO5 | 1227 | 699937 | T | RECESSIVE | 0.0267710 | 0.72 |
| TMEM63B | 1228 | 1935611 | A | DOMINANT | 0.0021920 | 0.74 |
| ELOVL5 | 1229 | 10948744 | G | DOMINANT | 0.0049312 | 1.28 |
| ELOVL5 | 1230 | 209485 | A | RECESSIVE | 0.0440659 | 0.81 |
| ELOVL5 | 1231 | 1579454 | G | ADDITIVE | 0.0157892 | 0.82 |
| ELOVL5 | 1232 | 9474507 | A | ADDITIVE | 0.0170088 | 0.82 |
| ELOVL5 | 1233 | 9296711 | G | ADDITIVE | 0.0061497 | 0.83 |
| RIMS1 | 1234 | 9360527 | T | DOMINANT | 0.0207283 | 1.24 |
| RIMS1 | 1235 | 2349095 | T | ADDITIVE | 0.0427535 | 1.17 |
| HTR1B | 1236 | 6296 | C | ADDITIVE | 0.0424589 | 0.90 |
| GABRR2 | 1238 | 9294426 | A | ADDITIVE | 0.0405476 | 0.92 |
| GABRR2 | 1239 | 9344920 | T | ADDITIVE | 0.0183365 | 0.86 |
| TRDN | 1244 | 7773653 | T | DOMINANT | 0.0076876 | 1.31 |
| TRDN | 1245 | 1431284 | G | RECESSIVE | 0.0445839 | 0.77 |
| TRDN | 1246 | 17737857 | C | RECESSIVE | 0.0128481 | 0.78 |
| TRDN | 1249 | 6905508 | T | DOMINANT | 0.0214175 | 1.22 |
| TRDN | 1250 | 1570187 | C | DOMINANT | 0.0299527 | 1.21 |
| TRDN | 1251 | 1570186 | T | DOMINANT | 0.0370378 | 1.20 |
| TRDN | 1252 | 1853158 | G | DOMINANT | 0.0219061 | 1.22 |
| TRDN | 1253 | 6915835 | C | DOMINANT | 0.0313070 | 1.21 |
| TRDN | 1254 | 9398739 | T | DOMINANT | 0.0077908 | 1.26 |
| TRDN | 1255 | 7453704 | C | DOMINANT | 0.0440035 | 1.19 |
| TRDN | 1256 | 1853157 | A | DOMINANT | 0.0169131 | 1.23 |
| TRDN | 1257 | 9285452 | G | DOMINANT | 0.0091034 | 1.26 |
| TRDN | 1258 | 1459767 | C | DOMINANT | 0.0127535 | 1.25 |
| NKAIN2 | 1259 | 342660 | A | DOMINANT | 0.0416553 | 0.70 |
| NKAIN2 | 1260 | 342641 | T | DOMINANT | 0.0464314 | 0.72 |
| EYA4 | 1264 | 7454561 | G | RECESSIVE | 0.0330682 | 0.80 |
| PDE7B | 1266 | 7761961 | T | DOMINANT | 0.0279036 | 1.22 |
| PDE7B | 1267 | 6916194 | T | ADDITIVE | 0.0427785 | 1.12 |
| PDE7B | 1268 | 4074263 | T | ADDITIVE | 0.0300311 | 1.42 |
| UTRN | 1275 | 9373430 | A | RECESSIVE | 0.0306231 | 1.32 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| SYNE1 | 1276 | 2763031 | T | DOMINANT | 0.0248949 | 0.82 |
| SYNE1 | 1277 | 2635470 | C | DOMINANT | 0.0242862 | 0.82 |
| SYNE1 | 1278 | 2635469 | A | DOMINANT | 0.0378937 | 0.83 |
| SYNE1 | 1279 | 1324452 | T | DOMINANT | 0.0422846 | 0.84 |
| SYNE1 | 1280 | 2763015 | A | RECESSIVE | 0.0149143 | 1.29 |
| SLC22A3 | 1281 | 372665 | C | RECESSIVE | 0.0062916 | 0.68 |
| SLC22A3 | 1282 | 377551 | A | RECESSIVE | 0.0114600 | 0.67 |
| PDE10A | 1293 | 6906719 | A | ADDITIVE | 0.0136527 | 0.82 |
| PDE10A | 1294 | 481701 | C | RECESSIVE | 0.0167779 | 0.39 |
| SDK1 | 1295 | 651245 | A | RECESSIVE | 0.0329166 | 1.29 |
| SDK1 | 1296 | 4723420 | A | DOMINANT | 0.0357213 | 0.82 |
| SDK1 | 1297 | 12701426 | A | RECESSIVE | 0.0399629 | 1.26 |
| NXPH1 | 1305 | 3779355 | A | RECESSIVE | 0.0233636 | 1.38 |
| ETV1 | 1306 | 118020 | G | DOMINANT | 0.0403479 | 1.20 |
| DGKB | 1309 | 6461071 | C | DOMINANT | 0.0136856 | 1.24 |
| DGKB | 1310 | 6461072 | A | DOMINANT | 0.0097236 | 1.25 |
| DGKB | 1312 | 2049447 | C | ADDITIVE | 0.0165858 | 0.83 |
| DGKB | 1313 | 6967001 | C | RECESSIVE | 0.0344874 | 1.70 |
| TSPAN13 | 1317 | 706057 | T | RECESSIVE | 0.0356695 | 1.27 |
| SNX13 | 1318 | 4543441 | A | ADDITIVE | 0.0474867 | 0.88 |
| SNX13 | 1319 | 4544985 | C | ADDITIVE | 0.0438740 | 0.88 |
| STK31 | 1321 | 10950956 | T | DOMINANT | 0.0196026 | 1.24 |
| STK31 | 1322 | 6955786 | G | DOMINANT | 0.0136536 | 1.24 |
| STK31 | 1323 | 13244337 | G | DOMINANT | 0.0122712 | 1.25 |
| STK31 | 1324 | 2158055 | C | RECESSIVE | 0.0227590 | 1.75 |
| STK31 | 1325 | 12667136 | T | RECESSIVE | 0.0297902 | 1.71 |
| SKAP2 | 1327 | 550141 | C | DOMINANT | 0.0302471 | 1.21 |
| SKAP2 | 1328 | 17315929 | T | RECESSIVE | 0.0449551 | 0.68 |
| SKAP2 | 1329 | 1391805 | G | DOMINANT | 0.0115043 | 1.25 |
| CREB5 | 1330 | 2237361 | C | ADDITIVE | 0.0024760 | 0.85 |
| CREB5 | 1331 | 2237364 | G | ADDITIVE | 0.0136271 | 0.83 |
| PLEKHA8 | 1332 | 10951257 | G | DOMINANT | 0.0262302 | 0.81 |
| PLEKHA8 | 1333 | 11975645 | C | DOMINANT | 0.0281621 | 0.81 |
| CRHR2 | 1334 | 973002 | G | ADDITIVE | 0.0383946 | 0.83 |
| BMPER | 1344 | 6968741 | G | RECESSIVE | 0.0266098 | 0.21 |
| EEPD1 | 1346 | 2098368 | C | ADDITIVE | 0.0336799 | 0.85 |
| VPS41 | 1347 | 11765454 | G | ADDITIVE | 0.0058268 | 1.20 |
| VPS41 | 1348 | 6462862 | A | DOMINANT | 0.0358235 | 0.83 |
| VPS41 | 1349 | 2240355 | A | ADDITIVE | 0.0391994 | 0.85 |
| VPS41 | 1350 | 10262154 | T | ADDITIVE | 0.0046053 | 1.19 |
| VPS41 | 1351 | 3801145 | C | DOMINANT | 0.0214666 | 0.82 |
| VPS41 | 1352 | 3779127 | G | ADDITIVE | 0.0029837 | 1.19 |
| VPS41 | 1353 | 10279367 | A | ADDITIVE | 0.0055477 | 1.23 |
| VPS41 | 1354 | 6961672 | C | DOMINANT | 0.0320528 | 0.83 |
| VPS41 | 1355 | 2286080 | C | ADDITIVE | 0.0030299 | 1.20 |
| VPS41 | 1356 | 4723789 | T | ADDITIVE | 0.0043633 | 1.22 |
| VPS41 | 1357 | 6462865 | G | ADDITIVE | 0.0122099 | 1.17 |
| VPS41 | 1358 | 6957565 | C | ADDITIVE | 0.0072009 | 1.15 |
| VPS41 | 1359 | 17618395 | G | ADDITIVE | 0.0110340 | 1.20 |
| VPS41 | 1360 | 4723793 | G | DOMINANT | 0.0067641 | 0.79 |
| VPS41 | 1361 | 17680408 | A | ADDITIVE | 0.0042231 | 1.23 |
| VPS41 | 1362 | 6462868 | G | ADDITIVE | 0.0034174 | 1.20 |
| VPS41 | 1363 | 6946636 | C | ADDITIVE | 0.0066739 | 1.22 |
| VPS41 | 1364 | 10085898 | C | ADDITIVE | 0.0034282 | 1.21 |
| VPS41 | 1365 | 7798033 | C | ADDITIVE | 0.0239792 | 1.17 |
| VPS41 | 1366 | 10951578 | C | ADDITIVE | 0.0151908 | 1.19 |
| VPS41 | 1367 | 10255290 | A | RECESSIVE | 0.0472003 | 1.37 |
| VPS41 | 1368 | 10255854 | T | RECESSIVE | 0.0391532 | 1.39 |
| VPS41 | 1369 | 859522 | G | RECESSIVE | 0.0264937 | 0.21 |
| IGFBP3 | 1370 | 1553009 | A | ADDITIVE | 0.0479207 | 0.87 |
| IGFBP3 | 1371 | 10282088 | A | ADDITIVE | 0.0296121 | 0.84 |
| IGFBP3 | 1372 | 10499637 | A | ADDITIVE | 0.0337505 | 0.86 |
| GRB10 | 1399 | 6976501 | G | DOMINANT | 0.0031246 | 1.31 |
| GRB10 | 1400 | 2329489 | C | DOMINANT | 0.0231994 | 1.22 |
| GRB10 | 1401 | 13311390 | G | DOMINANT | 0.0138341 | 1.24 |
| GRB10 | 1402 | 1978208 | G | DOMINANT | 0.0175505 | 1.25 |
| GRB10 | 1403 | 10265504 | A | DOMINANT | 0.0268050 | 1.21 |
| GRB10 | 1404 | 6968827 | A | DOMINANT | 0.0097772 | 1.26 |
| GRB10 | 1405 | 12536500 | T | DOMINANT | 0.0293983 | 1.21 |
| GRB10 | 1406 | 17134002 | A | DOMINANT | 0.0191867 | 1.23 |
| GRB10 | 1407 | 1019000 | T | DOMINANT | 0.0063420 | 1.27 |
| GRB10 | 1408 | 757774 | G | DOMINANT | 0.0132302 | 1.25 |
| GRB10 | 1409 | 6593164 | C | DOMINANT | 0.0288063 | 1.21 |
| GRB10 | 1410 | 10281065 | A | DOMINANT | 0.0243187 | 1.22 |
| GRB10 | 1411 | 6593174 | T | DOMINANT | 0.0259624 | 1.22 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| GRB10 | 1412 | 2876846 | C | DOMINANT | 0.0279213 | 1.21 |
| GRB10 | 1413 | 11238326 | G | DOMINANT | 0.0280415 | 1.21 |
| GRB10 | 1414 | 6963498 | C | DOMINANT | 0.0287868 | 1.21 |
| GRB10 | 1415 | 6593182 | G | DOMINANT | 0.0179188 | 1.25 |
| GRB10 | 1416 | 6943901 | G | DOMINANT | 0.0324424 | 1.21 |
| GRB10 | 1417 | 6971834 | T | DOMINANT | 0.0324424 | 1.21 |
| WBSCR17 | 1419 | 6979579 | C | DOMINANT | 0.0463092 | 0.82 |
| WBSCR17 | 1420 | 648415 | T | ADDITIVE | 0.0281075 | 0.88 |
| WBSCR17 | 1421 | 995497 | T | ADDITIVE | 0.0158683 | 0.83 |
| CALN1 | 1422 | 3801156 | T | DOMINANT | 0.0082123 | 1.31 |
| CALN1 | 1423 | 749585 | T | DOMINANT | 0.0102443 | 1.29 |
| CALN1 | 1424 | 12673109 | T | RECESSIVE | 0.0041836 | 0.47 |
| CALN1 | 1425 | 6963114 | A | RECESSIVE | 0.0087261 | 0.50 |
| CALN1 | 1426 | 10254309 | C | RECESSIVE | 0.0084468 | 0.50 |
| CALN1 | 1427 | 10950297 | C | RECESSIVE | 0.0053872 | 0.48 |
| CALN1 | 1428 | 12666578 | A | RECESSIVE | 0.0090005 | 0.47 |
| CALN1 | 1429 | 10260183 | C | RECESSIVE | 0.0022818 | 0.37 |
| CALN1 | 1430 | 10260420 | C | RECESSIVE | 0.0011975 | 0.34 |
| CALN1 | 1435 | 9638655 | A | DOMINANT | 0.0318496 | 1.22 |
| CALN1 | 1436 | 6946380 | A | RECESSIVE | 0.0477544 | 0.76 |
| MAGI2 | 1441 | 38107 | A | RECESSIVE | 0.0360157 | 1.38 |
| MAGI2 | 1442 | 38111 | G | RECESSIVE | 0.0141213 | 1.38 |
| MAGI2 | 1448 | 860246 | A | DOMINANT | 0.0235468 | 0.82 |
| CACNA2D1 | 1449 | 37068 | C | RECESSIVE | 0.0314903 | 0.76 |
| CACNA2D1 | 1450 | 37076 | G | RECESSIVE | 0.0487669 | 0.77 |
| PCLO | 1451 | 2107828 | A | ADDITIVE | 0.0074065 | 1.18 |
| PCLO | 1452 | 10954694 | C | RECESSIVE | 0.0350386 | 0.76 |
| PCLO | 1453 | 7781142 | A | ADDITIVE | 0.0138359 | 1.14 |
| PCLO | 1454 | 7799260 | C | ADDITIVE | 0.0119021 | 1.15 |
| PCLO | 1455 | 1034780 | C | ADDITIVE | 0.0174271 | 1.17 |
| PCLO | 1456 | 7778238 | C | ADDITIVE | 0.0068488 | 0.82 |
| PCLO | 1457 | 12707567 | G | RECESSIVE | 0.0459516 | 1.30 |
| PCLO | 1458 | 10240976 | A | RECESSIVE | 0.0314341 | 1.27 |
| PPP1R9A | 1466 | 17305991 | T | RECESSIVE | 0.0233510 | 0.78 |
| PPP1R9A | 1467 | 7806304 | C | ADDITIVE | 0.0480923 | 0.89 |
| PPP1R9A | 1468 | 854520 | T | DOMINANT | 0.0495215 | 1.21 |
| PPP1R9A | 1469 | 854521 | C | ADDITIVE | 0.0398185 | 0.85 |
| PPP1R9A | 1470 | 854531 | T | DOMINANT | 0.0403329 | 1.20 |
| PPP1R9A | 1471 | 854532 | T | DOMINANT | 0.0441487 | 1.19 |
| PPP1R9A | 1472 | 854534 | A | DOMINANT | 0.0149600 | 1.25 |
| PPP1R9A | 1473 | 854535 | C | DOMINANT | 0.0182574 | 1.24 |
| PPP1R9A | 1474 | 854537 | A | ADDITIVE | 0.0156679 | 0.85 |
| DYNC1I1 | 1476 | 4729206 | G | ADDITIVE | 0.0045583 | 1.37 |
| DYNC1I1 | 1477 | 2171555 | A | ADDITIVE | 0.0145986 | 1.19 |
| DYNC1I1 | 1478 | 13238456 | C | ADDITIVE | 0.0210332 | 1.19 |
| ZNF3 | 1480 | 6465760 | A | DOMINANT | 0.0475339 | 1.19 |
| ZNF3 | 1481 | 4424195 | G | DOMINANT | 0.0200763 | 1.22 |
| EMID2 | 1482 | 4727494 | G | DOMINANT | 0.0023064 | 0.77 |
| EMID2 | 1483 | 869127 | T | ADDITIVE | 0.0455470 | 0.78 |
| CUX1 | 1486 | 2694166 | A | RECESSIVE | 0.0007876 | 1.97 |
| NRCAM | 1496 | 10262724 | A | RECESSIVE | 0.0467176 | 1.33 |
| KCND2 | 1497 | 10276880 | G | ADDITIVE | 0.0262938 | 1.47 |
| CADPS2 | 1503 | 916982 | G | RECESSIVE | 0.0416549 | 0.71 |
| CADPS2 | 1504 | 2501439 | C | ADDITIVE | 0.0425517 | 1.13 |
| GRM8 | 1512 | 712723 | C | DOMINANT | 0.0250489 | 1.23 |
| GRM8 | 1513 | 10228052 | T | DOMINANT | 0.0385174 | 1.22 |
| GRM8 | 1514 | 11978873 | T | ADDITIVE | 0.0455030 | 0.88 |
| GRM8 | 1515 | 17680718 | C | DOMINANT | 0.0197320 | 1.23 |
| GRM8 | 1516 | 766239 | G | DOMINANT | 0.0197320 | 1.23 |
| GRM8 | 1517 | 2299449 | A | DOMINANT | 0.0210484 | 1.23 |
| GRM8 | 1518 | 2237735 | A | DOMINANT | 0.0210484 | 1.23 |
| GRM8 | 1519 | 2283065 | C | DOMINANT | 0.0163372 | 1.24 |
| GRM8 | 1520 | 2283066 | C | DOMINANT | 0.0201634 | 1.23 |
| GRM8 | 1521 | 12154335 | T | DOMINANT | 0.0426821 | 1.20 |
| GRM8 | 1522 | 2023640 | T | ADDITIVE | 0.0058360 | 1.18 |
| GRM8 | 1523 | 2299523 | A | ADDITIVE | 0.0075430 | 0.81 |
| GRM8 | 1524 | 1018854 | G | ADDITIVE | 0.0051250 | 0.82 |
| GRM8 | 1525 | 2188187 | C | ADDITIVE | 0.0098052 | 1.17 |
| GRM8 | 1526 | 1156652 | G | ADDITIVE | 0.0017295 | 1.16 |
| GRM8 | 1527 | 1156654 | A | ADDITIVE | 0.0022243 | 1.17 |
| GRM8 | 1528 | 11563730 | T | ADDITIVE | 0.0074010 | 1.20 |
| GRM8 | 1529 | 1419442 | T | ADDITIVE | 0.0014619 | 1.28 |
| DGKI | 1532 | 4732255 | T | RECESSIVE | 0.0281503 | 1.31 |
| DGKI | 1533 | 12535157 | A | RECESSIVE | 0.0441275 | 1.30 |
| DGKI | 1534 | 4728415 | G | RECESSIVE | 0.0429775 | 1.28 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| DGKI | 1535 | 2113578 | T | ADDITIVE | 0.0293521 | 1.10 |
| DGKI | 1536 | 12707359 | T | RECESSIVE | 0.0042222 | 1.33 |
| DGKI | 1537 | 7793852 | G | RECESSIVE | 0.0034265 | 1.34 |
| CREB3L2 | 1541 | 1020961 | T | DOMINANT | 0.0396712 | 1.20 |
| CREB3L2 | 1542 | 9757 | G | DOMINANT | 0.0238794 | 1.22 |
| CREB3L2 | 1544 | 11972734 | A | DOMINANT | 0.0391734 | 1.20 |
| TBXAS1 | 1546 | 2269997 | T | DOMINANT | 0.0398368 | 1.20 |
| CNTNAP2 | 1547 | 6969607 | C | ADDITIVE | 0.0266035 | 0.88 |
| CNTNAP2 | 1548 | 12703906 | T | ADDITIVE | 0.0343689 | 0.91 |
| CNTNAP2 | 1549 | 7803992 | A | ADDITIVE | 0.0366156 | 1.19 |
| CNTNAP2 | 1550 | 1542566 | G | ADDITIVE | 0.0084223 | 1.16 |
| CNTNAP2 | 1551 | 826811 | C | ADDITIVE | 0.0016559 | 1.19 |
| CNTNAP2 | 1552 | 700309 | A | ADDITIVE | 0.0042302 | 1.16 |
| CNTNAP2 | 1553 | 1525218 | T | ADDITIVE | 0.0071294 | 1.16 |
| CNTNAP2 | 1554 | 11972784 | C | ADDITIVE | 0.0034040 | 1.17 |
| CNTNAP2 | 1555 | 4726861 | A | ADDITIVE | 0.0061281 | 1.19 |
| CNTNAP2 | 1556 | 10242076 | A | ADDITIVE | 0.0416655 | 1.11 |
| CNTNAP2 | 1557 | 2022225 | A | ADDITIVE | 0.0059064 | 1.17 |
| CNTNAP2 | 1558 | 10276608 | G | ADDITIVE | 0.0043470 | 1.17 |
| CNTNAP2 | 1559 | 12703913 | C | ADDITIVE | 0.0041744 | 1.16 |
| CNTNAP2 | 1560 | 7789396 | A | ADDITIVE | 0.0042509 | 1.16 |
| CNTNAP2 | 1561 | 2373133 | G | ADDITIVE | 0.0037206 | 1.16 |
| CNTNAP2 | 1562 | 6947428 | C | ADDITIVE | 0.0032470 | 1.17 |
| CNTNAP2 | 1563 | 10270551 | G | ADDITIVE | 0.0041744 | 1.16 |
| CNTNAP2 | 1564 | 10260458 | T | RECESSIVE | 0.0067884 | 1.58 |
| CNTNAP2 | 1565 | 3915305 | C | ADDITIVE | 0.0034758 | 1.17 |
| CNTNAP2 | 1566 | 4725731 | T | ADDITIVE | 0.0033189 | 1.16 |
| CNTNAP2 | 1567 | 10952682 | G | ADDITIVE | 0.0082219 | 1.14 |
| CNTNAP2 | 1568 | 10952685 | A | ADDITIVE | 0.0041685 | 1.15 |
| CNTNAP2 | 1569 | 4726875 | A | DOMINANT | 0.0054919 | 1.28 |
| CNTNAP2 | 1570 | 1528507 | C | DOMINANT | 0.0038729 | 1.30 |
| CNTNAP2 | 1571 | 2888516 | C | RECESSIVE | 0.0495788 | 0.69 |
| CNTNAP2 | 1572 | 851653 | A | ADDITIVE | 0.0498081 | 0.91 |
| CNTNAP2 | 1573 | 10251347 | G | DOMINANT | 0.0085100 | 1.55 |
| ACCN3 | 1574 | 891507 | T | ADDITIVE | 0.0414271 | 0.83 |
| DPP6 | 1575 | 916513 | G | RECESSIVE | 0.0249396 | 3.08 |
| DPP6 | 1576 | 880730 | A | RECESSIVE | 0.0352403 | 0.72 |
| DPP6 | 1577 | 729269 | T | ADDITIVE | 0.0367995 | 1.16 |
| HTR5A | 1578 | 1657276 | C | RECESSIVE | 0.0487329 | 0.77 |
| HTR5A | 1579 | 1657283 | G | RECESSIVE | 0.0101954 | 0.68 |
| PTPRN2 | 1580 | 221295 | A | RECESSIVE | 0.0227256 | 0.79 |
| PTPRN2 | 1581 | 221300 | C | RECESSIVE | 0.0369780 | 0.81 |
| PTPRN2 | 1582 | 221303 | A | RECESSIVE | 0.0030937 | 0.74 |
| PTPRN2 | 1583 | 4716881 | A | RECESSIVE | 0.0324292 | 0.74 |
| PTPRN2 | 1584 | 13307400 | C | RECESSIVE | 0.0185490 | 0.71 |
| CSMD1 | 1586 | 341724 | C | ADDITIVE | 0.0081167 | 1.22 |
| CSMD1 | 1587 | 688894 | G | DOMINANT | 0.0296692 | 1.22 |
| CSMD1 | 1588 | 11136609 | T | DOMINANT | 0.0212984 | 1.24 |
| CSMD1 | 1589 | 1348267 | C | DOMINANT | 0.0070134 | 0.79 |
| CSMD1 | 1590 | 10092265 | G | DOMINANT | 0.0056497 | 0.79 |
| CSMD1 | 1591 | 7819225 | C | ADDITIVE | 0.0237828 | 0.85 |
| CSMD1 | 1592 | 270054 | A | DOMINANT | 0.0250442 | 0.82 |
| CSMD1 | 1593 | 12543159 | T | ADDITIVE | 0.0102090 | 0.82 |
| CSMD1 | 1594 | 9969557 | T | ADDITIVE | 0.0306538 | 0.88 |
| CSMD1 | 1595 | 7005990 | G | ADDITIVE | 0.0073525 | 0.82 |
| CSMD1 | 1596 | 7014229 | T | ADDITIVE | 0.0165635 | 0.82 |
| MCPH1 | 1598 | 2442633 | G | DOMINANT | 0.0243083 | 0.81 |
| MCPH1 | 1599 | 3020213 | T | DOMINANT | 0.0171547 | 0.81 |
| MCPH1 | 1600 | 2515435 | C | DOMINANT | 0.0397371 | 0.83 |
| MCPH1 | 1602 | 1375668 | G | RECESSIVE | 0.0154748 | 1.42 |
| MCPH1 | 1603 | 4455855 | A | RECESSIVE | 0.0308755 | 1.37 |
| MCPH1 | 1604 | 17624022 | C | ADDITIVE | 0.0022198 | 0.77 |
| MCPH1 | 1605 | 3739391 | A | DOMINANT | 0.0102519 | 0.78 |
| MCPH1 | 1606 | 3739392 | G | ADDITIVE | 0.0135040 | 0.80 |
| MCPH1 | 1607 | 2515514 | A | DOMINANT | 0.0308876 | 0.81 |
| MCPH1 | 1608 | 2912084 | C | ADDITIVE | 0.0313028 | 0.88 |
| ANGPT2 | 1609 | 7825811 | T | RECESSIVE | 0.0427316 | 0.29 |
| SGCZ | 1611 | 10092634 | C | RECESSIVE | 0.0394393 | 1.26 |
| SGCZ | 1612 | 2054356 | G | RECESSIVE | 0.0179649 | 1.34 |
| SGCZ | 1613 | 1551816 | C | RECESSIVE | 0.0224905 | 1.32 |
| SGCZ | 1614 | 1510445 | C | RECESSIVE | 0.0247559 | 0.63 |
| SGCZ | 1615 | 11989868 | C | RECESSIVE | 0.0363739 | 0.67 |
| SGCZ | 1616 | 11990657 | A | RECESSIVE | 0.0313972 | 0.66 |
| SGCZ | 1617 | 11998116 | G | RECESSIVE | 0.0231300 | 0.65 |
| SGCZ | 1618 | 7822045 | A | RECESSIVE | 0.0250617 | 0.67 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| SLC7A2 | 1620 | 2588164 | A | ADDITIVE | 0.0366482 | 0.88 |
| ATP6V1B2 | 1627 | 13253777 | G | ADDITIVE | 0.0206804 | 1.15 |
| XPO7 | 1628 | 11135789 | C | DOMINANT | 0.0275765 | 0.83 |
| PPP3CC | 1629 | 7827093 | C | RECESSIVE | 0.0426589 | 0.80 |
| PPP3CC | 1630 | 11778831 | T | RECESSIVE | 0.0414312 | 0.80 |
| PPP3CC | 1631 | 2469757 | T | RECESSIVE | 0.0442273 | 0.80 |
| PPP3CC | 1632 | 2461491 | C | RECESSIVE | 0.0326578 | 0.79 |
| PPP3CC | 1633 | 2469760 | G | RECESSIVE | 0.0401341 | 0.80 |
| PPP3CC | 1634 | 2461481 | A | RECESSIVE | 0.0268717 | 0.78 |
| PPP3CC | 1635 | 1116084 | A | RECESSIVE | 0.0232025 | 0.78 |
| PPP3CC | 1636 | 1482337 | T | RECESSIVE | 0.0474068 | 0.80 |
| SLC25A37 | 1638 | 7826247 | G | RECESSIVE | 0.0133535 | 1.52 |
| UNC5D | 1642 | 7841785 | A | RECESSIVE | 0.0121948 | 0.35 |
| UNC5D | 1643 | 6989128 | A | RECESSIVE | 0.0233071 | 0.40 |
| UNC5D | 1644 | 983270 | A | RECESSIVE | 0.0088917 | 0.34 |
| UNC5D | 1645 | 983273 | G | RECESSIVE | 0.0233071 | 0.40 |
| UNC5D | 1646 | 4739416 | G | RECESSIVE | 0.0027065 | 0.25 |
| UNC5D | 1647 | 10954992 | C | ADDITIVE | 0.0318533 | 0.88 |
| SNTG1 | 1656 | 2450290 | G | RECESSIVE | 0.0077811 | >5 |
| SNTG1 | 1657 | 318861 | G | RECESSIVE | 0.0078474 | >5 |
| SNTG1 | 1659 | 10504093 | G | RECESSIVE | 0.0300981 | >5 |
| SNTG1 | 1661 | 1344326 | G | RECESSIVE | 0.0154496 | >5 |
| SNTG1 | 1662 | 11783503 | G | RECESSIVE | 0.0300981 | >5 |
| SNTG1 | 1664 | 11783631 | T | RECESSIVE | 0.0300284 | >5 |
| SNTG1 | 1667 | 203632 | T | DOMINANT | 0.0386653 | 0.83 |
| SNTG1 | 1671 | 6997739 | C | RECESSIVE | 0.0053340 | 0.50 |
| SNTG1 | 1672 | 4440649 | C | DOMINANT | 0.0359079 | 0.78 |
| LYN | 1674 | 907424 | A | RECESSIVE | 0.0428401 | 1.24 |
| LYN | 1675 | 1877301 | T | RECESSIVE | 0.0371189 | 1.25 |
| LYN | 1676 | 868541 | A | RECESSIVE | 0.0395984 | 1.24 |
| LYN | 1677 | 1027986 | C | RECESSIVE | 0.0368128 | 1.25 |
| LYN | 1678 | 10282821 | A | ADDITIVE | 0.0229134 | 1.15 |
| NKAIN3 | 1682 | 17243191 | T | RECESSIVE | 0.0158950 | 1.51 |
| NKAIN3 | 1683 | 1376759 | A | ADDITIVE | 0.0334432 | 1.09 |
| NKAIN3 | 1685 | 10458307 | T | ADDITIVE | 0.0298413 | 1.17 |
| DEPDC2 | 1690 | 1434764 | A | RECESSIVE | 0.0383367 | 1.29 |
| DEPDC2 | 1691 | 1014663 | C | RECESSIVE | 0.0378064 | 1.30 |
| KCNB2 | 1692 | 13251896 | G | DOMINANT | 0.0148115 | 1.25 |
| KCNB2 | 1693 | 2256431 | A | DOMINANT | 0.0208368 | 1.22 |
| KCNB2 | 1694 | 1972888 | C | DOMINANT | 0.0192951 | 1.22 |
| KCNB2 | 1695 | 2256012 | C | DOMINANT | 0.0409104 | 1.20 |
| KCNB2 | 1696 | 2196904 | C | DOMINANT | 0.0019747 | 1.31 |
| KCNB2 | 1697 | 1899077 | T | DOMINANT | 0.0426818 | 1.19 |
| KCNB2 | 1698 | 1866740 | A | DOMINANT | 0.0199283 | 1.22 |
| KCNB2 | 1699 | 1440355 | C | DOMINANT | 0.0390306 | 1.19 |
| KCNB2 | 1700 | 2247121 | A | DOMINANT | 0.0175706 | 1.23 |
| KCNB2 | 1701 | 2243607 | G | DOMINANT | 0.0235291 | 1.22 |
| KCNB2 | 1702 | 1965805 | G | DOMINANT | 0.0374924 | 1.20 |
| KCNB2 | 1703 | 2919408 | G | DOMINANT | 0.0052564 | 1.28 |
| KCNB2 | 1704 | 4571768 | G | ADDITIVE | 0.0087585 | 1.21 |
| KCNB2 | 1705 | 4307385 | C | ADDITIVE | 0.0262631 | 1.17 |
| KCNB2 | 1706 | 4307386 | C | ADDITIVE | 0.0223659 | 1.13 |
| KCNB2 | 1707 | 10096802 | A | RECESSIVE | 0.0400735 | 1.24 |
| KCNB2 | 1708 | 7006287 | G | RECESSIVE | 0.0417485 | 1.24 |
| MMP16 | 1710 | 10100297 | G | DOMINANT | 0.0093713 | 1.25 |
| MMP16 | 1711 | 4961087 | C | DOMINANT | 0.0061100 | 1.27 |
| MMP16 | 1713 | 4548227 | A | DOMINANT | 0.0052824 | 1.27 |
| ZFPM2 | 1735 | 16873003 | C | RECESSIVE | 0.0291068 | 1.55 |
| ZFPM2 | 1737 | 7823133 | T | RECESSIVE | 0.0399677 | 1.51 |
| ZFPM2 | 1738 | 6992053 | A | RECESSIVE | 0.0399677 | 1.51 |
| ZFPM2 | 1739 | 1481026 | T | RECESSIVE | 0.0310871 | 1.55 |
| CSMD3 | 1742 | 4876279 | T | DOMINANT | 0.0239791 | 1.23 |
| CSMD3 | 1743 | 17628739 | G | DOMINANT | 0.0403819 | 0.83 |
| CSMD3 | 1744 | 17630545 | C | ADDITIVE | 0.0198970 | 0.87 |
| CSMD3 | 1745 | 10505182 | A | ADDITIVE | 0.0162187 | 0.86 |
| CSMD3 | 1746 | 1895016 | G | DOMINANT | 0.0319117 | 1.22 |
| CSMD3 | 1747 | 16883350 | A | DOMINANT | 0.0141110 | 0.79 |
| CSMD3 | 1748 | 929685 | T | ADDITIVE | 0.0127708 | 1.18 |
| CSMD3 | 1749 | 1420859 | T | ADDITIVE | 0.0251957 | 1.15 |
| CSMD3 | 1750 | 1492678 | A | DOMINANT | 0.0040323 | 0.76 |
| CSMD3 | 1751 | 3950676 | A | DOMINANT | 0.0032317 | 0.76 |
| CSMD3 | 1752 | 4876281 | G | RECESSIVE | 0.0130176 | 1.27 |
| CSMD3 | 1753 | 4876468 | T | DOMINANT | 0.0029974 | 0.75 |
| CSMD3 | 1754 | 4563913 | T | DOMINANT | 0.0043788 | 0.76 |
| CSMD3 | 1755 | 4556111 | T | ADDITIVE | 0.0266173 | 1.12 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| CSMD3 | 1756 | 1873746 | T | DOMINANT | 0.0040320 | 0.76 |
| CSMD3 | 1757 | 6994009 | A | RECESSIVE | 0.0080830 | 1.30 |
| CSMD3 | 1758 | 9886643 | C | RECESSIVE | 0.0071703 | 1.30 |
| CSMD3 | 1759 | 12676848 | A | RECESSIVE | 0.0090360 | 1.29 |
| CSMD3 | 1760 | 9649933 | A | RECESSIVE | 0.0112562 | 1.28 |
| CSMD3 | 1761 | 1492660 | A | ADDITIVE | 0.0325255 | 1.10 |
| CSMD3 | 1765 | 1513520 | G | RECESSIVE | 0.0237756 | 0.79 |
| FBXO32 | 1768 | 4870855 | A | ADDITIVE | 0.0396670 | 0.78 |
| FER1L6 | 1777 | 6981430 | G | DOMINANT | 0.0380371 | 1.21 |
| MTSS1 | 1778 | 2013845 | G | ADDITIVE | 0.0125099 | 0.87 |
| MTSS1 | 1779 | 9771920 | T | RECESSIVE | 0.0433217 | 0.52 |
| MTSS1 | 1780 | 919544 | A | ADDITIVE | 0.0082588 | 0.82 |
| MTSS1 | 1781 | 3901290 | C | RECESSIVE | 0.0032857 | 2.47 |
| DDEF1 | 1785 | 2670886 | C | RECESSIVE | 0.0066020 | 0.35 |
| ADCY8 | 1786 | 6986982 | A | RECESSIVE | 0.0136146 | 0.46 |
| ADCY8 | 1787 | 11776982 | C | RECESSIVE | 0.0225496 | 0.50 |
| ADCY8 | 1788 | 7461448 | A | RECESSIVE | 0.0219152 | 0.50 |
| COL22A1 | 1790 | 7017524 | A | DOMINANT | 0.0234086 | 0.79 |
| COL22A1 | 1791 | 10875432 | G | RECESSIVE | 0.0327652 | 1.45 |
| COL22A1 | 1792 | 7818881 | C | ADDITIVE | 0.0282287 | 1.13 |
| COL22A1 | 1793 | 10090299 | C | ADDITIVE | 0.0199321 | 1.14 |
| COL22A1 | 1794 | 7838300 | C | ADDITIVE | 0.0226159 | 1.16 |
| COL22A1 | 1795 | 7838450 | C | ADDITIVE | 0.0330791 | 1.16 |
| COL22A1 | 1796 | 9324497 | G | ADDITIVE | 0.0286441 | 1.15 |
| COL22A1 | 1797 | 2292927 | T | RECESSIVE | 0.0073296 | 1.84 |
| COL22A1 | 1798 | 4736221 | T | RECESSIVE | 0.0010171 | 2.31 |
| COL22A1 | 1799 | 7006103 | C | RECESSIVE | 0.0006843 | 2.36 |
| COL22A1 | 1800 | 1879047 | T | RECESSIVE | 0.0010017 | 2.31 |
| KCNK9 | 1801 | 885724 | C | DOMINANT | 0.0271704 | 0.82 |
| PTP4A3 | 1802 | 7464176 | T | ADDITIVE | 0.0235240 | 1.18 |
| SMARCA2 | 1803 | 13288443 | G | DOMINANT | 0.0257316 | 0.79 |
| SMARCA2 | 1804 | 7035991 | T | DOMINANT | 0.0367617 | 0.80 |
| SMARCA2 | 1806 | 7858344 | T | DOMINANT | 0.0118075 | 0.76 |
| SMARCA2 | 1807 | 10965113 | C | DOMINANT | 0.0238185 | 0.80 |
| SMARCA2 | 1809 | 3818385 | T | DOMINANT | 0.0158222 | 0.77 |
| SLC1A1 | 1811 | 7045401 | G | RECESSIVE | 0.0038336 | 0.71 |
| SLC1A1 | 1813 | 4742013 | C | ADDITIVE | 0.0463596 | 0.75 |
| ADAMTSL1 | 1815 | 563805 | C | RECESSIVE | 0.0287211 | 1.89 |
| ASAH3L | 1816 | 2383096 | A | DOMINANT | 0.0218034 | 0.81 |
| KIAA1797 | 1817 | 10738564 | G | DOMINANT | 0.0338537 | 1.22 |
| KIAA1797 | 1818 | 7848159 | G | DOMINANT | 0.0283309 | 1.23 |
| KIAA1797 | 1820 | 17685673 | T | RECESSIVE | 0.0332263 | 1.29 |
| KIAA1797 | 1822 | 16938162 | C | RECESSIVE | 0.0191739 | 1.33 |
| KIAA1797 | 1823 | 10511687 | G | RECESSIVE | 0.0234244 | 1.33 |
| KIAA1797 | 1824 | 7025868 | G | ADDITIVE | 0.0234769 | 1.21 |
| KIAA1797 | 1825 | 6475483 | T | ADDITIVE | 0.0446537 | 1.16 |
| KIAA1797 | 1826 | 2383169 | C | ADDITIVE | 0.0326291 | 1.17 |
| KIAA1797 | 1827 | 2383170 | A | ADDITIVE | 0.0228506 | 1.20 |
| KIAA1797 | 1828 | 10738569 | A | ADDITIVE | 0.0316246 | 1.19 |
| KIAA1797 | 1829 | 4278230 | G | RECESSIVE | 0.0022173 | 0.73 |
| IFT74 | 1830 | 7035755 | G | ADDITIVE | 0.0186187 | 0.81 |
| IFT74 | 1831 | 7039400 | A | ADDITIVE | 0.0346589 | 0.82 |
| IFT74 | 1832 | 17756299 | C | DOMINANT | 0.0151261 | 0.74 |
| IFT74 | 1833 | 7857669 | A | ADDITIVE | 0.0144243 | 0.80 |
| IFT74 | 1835 | 17694631 | C | ADDITIVE | 0.0118149 | 0.78 |
| IFT74 | 1836 | 2095405 | C | ADDITIVE | 0.0108959 | 0.80 |
| TEK | 1837 | 1591355 | G | ADDITIVE | 0.0082850 | 0.80 |
| TEK | 1838 | 4601425 | T | RECESSIVE | 0.0014039 | 0.66 |
| PIP5K1B | 1841 | 4744726 | G | DOMINANT | 0.0314778 | 1.23 |
| PIP5K1B | 1842 | 1414949 | C | DOMINANT | 0.0244834 | 1.24 |
| PIP5K1B | 1843 | 11144133 | T | RECESSIVE | 0.0239211 | 0.79 |
| PIP5K1B | 1845 | 872077 | A | ADDITIVE | 0.0012371 | 0.76 |
| MAMDC2 | 1846 | 3015182 | C | ADDITIVE | 0.0415595 | 1.19 |
| MAMDC2 | 1847 | 3015189 | G | ADDITIVE | 0.0366178 | 1.19 |
| MAMDC2 | 1848 | 3015213 | A | ADDITIVE | 0.0424673 | 1.19 |
| MAMDC2 | 1849 | 3015223 | A | ADDITIVE | 0.0127180 | 1.26 |
| MAMDC2 | 1850 | 2182731 | C | ADDITIVE | 0.0104016 | 1.20 |
| TRPM3 | 1851 | 2275242 | G | ADDITIVE | 0.0427214 | 1.11 |
| TRPM3 | 1852 | 1415229 | A | ADDITIVE | 0.0374724 | 1.12 |
| TRPM3 | 1853 | 6560161 | G | ADDITIVE | 0.0439742 | 1.17 |
| TRPM3 | 1854 | 1337028 | T | ADDITIVE | 0.0286367 | 1.18 |
| TRPM3 | 1855 | 7022926 | G | ADDITIVE | 0.0339566 | 1.18 |
| TRPM3 | 1856 | 10868916 | C | ADDITIVE | 0.0338369 | 0.85 |
| TRPM6 | 1869 | 539079 | G | RECESSIVE | 0.0210478 | 4.08 |
| TRPM6 | 1870 | 506973 | C | RECESSIVE | 0.0329027 | 3.26 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| TRPM6 | 1871 | 2274924 | G | ADDITIVE | 0.0168181 | 1.22 |
| TRPM6 | 1872 | 3750425 | T | RECESSIVE | 0.0331844 | 3.25 |
| TRPM6 | 1873 | 12004677 | G | ADDITIVE | 0.0111713 | 1.22 |
| NTRK2 | 1884 | 1439054 | C | RECESSIVE | 0.0432386 | 0.33 |
| NTRK2 | 1886 | 1212171 | C | RECESSIVE | 0.0319888 | 0.79 |
| NTRK2 | 1887 | 1187329 | A | RECESSIVE | 0.0341744 | 0.79 |
| NTRK2 | 1888 | 3780632 | C | RECESSIVE | 0.0032326 | 0.67 |
| NTRK2 | 1889 | 10116453 | A | RECESSIVE | 0.0050538 | 0.62 |
| NTRK2 | 1890 | 7867174 | C | RECESSIVE | 0.0015349 | 0.65 |
| NTRK2 | 1891 | 1936435 | T | RECESSIVE | 0.0154401 | 0.70 |
| NTRK2 | 1892 | 7038866 | A | ADDITIVE | 0.0110408 | 0.90 |
| NTRK2 | 1893 | 1539676 | A | RECESSIVE | 0.0104620 | 0.68 |
| NTRK2 | 1894 | 2799482 | C | RECESSIVE | 0.0061924 | 0.69 |
| NTRK2 | 1895 | 2799483 | C | RECESSIVE | 0.0061924 | 0.69 |
| NTRK2 | 1896 | 1778913 | T | RECESSIVE | 0.0142011 | 1.62 |
| NTRK2 | 1897 | 10512154 | A | RECESSIVE | 0.0410501 | 1.49 |
| NTRK2 | 1898 | 9314735 | G | RECESSIVE | 0.0244377 | 1.58 |
| DAPK1 | 1899 | 6560011 | C | RECESSIVE | 0.0389489 | 0.79 |
| DAPK1 | 1900 | 11141934 | A | RECESSIVE | 0.0396753 | <.2 |
| DAPK1 | 1901 | 3128501 | G | RECESSIVE | 0.0199596 | 1.31 |
| SHC3 | 1903 | 9410299 | C | DOMINANT | 0.0305083 | 0.81 |
| ZNF169 | 1910 | 3118766 | C | RECESSIVE | 0.0379430 | 0.76 |
| GABBR2 | 1912 | 1435253 | T | ADDITIVE | 0.0416995 | 0.85 |
| GABBR2 | 1913 | 970388 | C | DOMINANT | 0.0148177 | 0.81 |
| GABBR2 | 1914 | 7850445 | G | DOMINANT | 0.0293185 | 0.83 |
| GRIN3A | 1915 | 9299345 | T | ADDITIVE | 0.0144311 | 0.78 |
| GRIN3A | 1916 | 10819954 | A | RECESSIVE | 0.0212699 | 0.65 |
| GRIN3A | 1917 | 10819959 | C | RECESSIVE | 0.0157693 | 0.63 |
| GRIN3A | 1918 | 1323421 | T | DOMINANT | 0.0302447 | 1.23 |
| GRIN3A | 1919 | 7849782 | C | RECESSIVE | 0.0088792 | 0.76 |
| GRIN3A | 1920 | 2146801 | T | DOMINANT | 0.0474707 | 1.19 |
| GRIN3A | 1921 | 1853447 | T | RECESSIVE | 0.0169973 | 0.62 |
| GRIN3A | 1922 | 12708308 | C | RECESSIVE | 0.0093364 | 0.60 |
| GRIN3A | 1923 | 4742823 | A | DOMINANT | 0.0370507 | 1.22 |
| GRIN3A | 1924 | 2485534 | A | RECESSIVE | 0.0107954 | 0.77 |
| GRIN3A | 1925 | 2506362 | C | DOMINANT | 0.0267598 | 1.24 |
| GRIN3A | 1926 | 10760802 | T | RECESSIVE | 0.0040421 | 0.74 |
| GRIN3A | 1927 | 4278209 | T | RECESSIVE | 0.0042671 | 0.74 |
| GRIN3A | 1928 | 2786720 | C | DOMINANT | 0.0030816 | 1.34 |
| PALM2 | 1937 | 10816929 | A | ADDITIVE | 0.0366808 | 1.12 |
| SVEP1 | 1938 | 4978934 | C | ADDITIVE | 0.0408891 | 0.90 |
| SVEP1 | 1939 | 10817042 | T | RECESSIVE | 0.0053090 | 0.65 |
| RGS3 | 1944 | 4979253 | G | DOMINANT | 0.0161113 | 0.81 |
| RGS3 | 1945 | 12337340 | C | RECESSIVE | 0.0194267 | 3.56 |
| ZNF618 | 1946 | 10121424 | T | DOMINANT | 0.0251012 | 1.21 |
| DFNB31 | 1956 | 10817625 | A | RECESSIVE | 0.0420573 | 1.24 |
| DFNB31 | 1957 | 10982246 | A | RECESSIVE | 0.0388448 | 1.23 |
| DFNB31 | 1958 | 1535964 | C | RECESSIVE | 0.0448325 | 1.27 |
| DFNB31 | 1959 | 10817635 | A | DOMINANT | 0.0146594 | 0.78 |
| DFNB31 | 1960 | 10817636 | A | DOMINANT | 0.0258219 | 0.80 |
| PAPPA | 1961 | 1475215 | A | RECESSIVE | 0.0186419 | 1.36 |
| ASTN2 | 1965 | 1876475 | A | DOMINANT | 0.0273090 | 0.82 |
| ASTN2 | 1966 | 767432 | A | RECESSIVE | 0.0101445 | 1.42 |
| ASTN2 | 1967 | 1475057 | T | DOMINANT | 0.0052805 | 0.78 |
| ASTN2 | 1968 | 1542987 | C | DOMINANT | 0.0063019 | 0.78 |
| ASTN2 | 1969 | 1885242 | A | DOMINANT | 0.0425887 | 0.83 |
| ASTN2 | 1970 | 803926 | C | RECESSIVE | 0.0167959 | 1.27 |
| ASTN2 | 1971 | 803929 | A | RECESSIVE | 0.0167959 | 1.27 |
| ASTN2 | 1972 | 2900132 | G | DOMINANT | 0.0273053 | 0.83 |
| ASTN2 | 1973 | 811689 | T | DOMINANT | 0.0363152 | 0.83 |
| ASTN2 | 1974 | 803939 | G | RECESSIVE | 0.0132340 | 1.29 |
| ASTN2 | 1975 | 10983314 | T | DOMINANT | 0.0176569 | 0.81 |
| ASTN2 | 1976 | 10759876 | A | RECESSIVE | 0.0325558 | 0.60 |
| ASTN2 | 1977 | 3849144 | G | RECESSIVE | 0.0359050 | 0.61 |
| ASTN2 | 1981 | 1928993 | C | ADDITIVE | 0.0227890 | 0.91 |
| ASTN2 | 1982 | 1928995 | G | RECESSIVE | 0.0192020 | 0.78 |
| ASTN2 | 1986 | 10739492 | A | ADDITIVE | 0.0380223 | 0.87 |
| ASTN2 | 1987 | 7032028 | T | RECESSIVE | 0.0165675 | 0.77 |
| ASTN2 | 1988 | 17419611 | T | DOMINANT | 0.0112128 | 1.28 |
| CDK5RAP2 | 1990 | 3849113 | C | RECESSIVE | 0.0356542 | 0.15 |
| CDK5RAP2 | 1991 | 10760103 | G | ADDITIVE | 0.0329487 | 0.77 |
| TTLL11 | 1997 | 13299260 | T | RECESSIVE | 0.0443712 | 0.82 |
| LHX6 | 2001 | 7859776 | T | DOMINANT | 0.0298107 | 0.83 |
| DENND1A | 2002 | 7047077 | T | RECESSIVE | 0.0056382 | 0.65 |
| DENND1A | 2003 | 7044960 | T | RECESSIVE | 0.0305607 | 0.70 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| DENND1A | 2004 | 3829851 | C | RECESSIVE | 0.0304882 | 4.73 |
| DENND1A | 2005 | 17212242 | C | DOMINANT | 0.0381496 | 1.23 |
| DENND1A | 2006 | 10760290 | T | RECESSIVE | 0.0073319 | 0.66 |
| DENND1A | 2007 | 10986026 | T | RECESSIVE | 0.0193819 | 0.70 |
| DENND1A | 2008 | 10986064 | T | RECESSIVE | 0.0082638 | 0.53 |
| DENND1A | 2009 | 1346643 | G | RECESSIVE | 0.0384185 | 0.70 |
| DENND1A | 2010 | 12377523 | A | RECESSIVE | 0.0380315 | 0.73 |
| DENND1A | 2011 | 670961 | A | DOMINANT | 0.0165799 | 1.28 |
| DENND1A | 2012 | 623640 | C | DOMINANT | 0.0213830 | 1.33 |
| DENND1A | 2013 | 630991 | A | ADDITIVE | 0.0354109 | 1.22 |
| NEK6 | 2014 | 4838141 | T | RECESSIVE | 0.0176925 | 0.75 |
| NEK6 | 2015 | 4838142 | T | RECESSIVE | 0.0173032 | 0.75 |
| NEK6 | 2016 | 7020077 | T | RECESSIVE | 0.0374866 | 0.39 |
| ABL1 | 2018 | 11244112 | T | RECESSIVE | 0.0104563 | 1.56 |
| ABL1 | 2019 | 2791728 | A | RECESSIVE | 0.0103761 | 1.56 |
| ABL1 | 2020 | 2583845 | A | RECESSIVE | 0.0101904 | 1.56 |
| ABL1 | 2021 | 2855160 | T | ADDITIVE | 0.0482647 | 1.11 |
| ABL1 | 2022 | 2789764 | T | RECESSIVE | 0.0060805 | 1.60 |
| ABL1 | 2023 | 2253070 | A | RECESSIVE | 0.0084280 | 1.57 |
| ABL1 | 2024 | 2253084 | T | RECESSIVE | 0.0133269 | 1.54 |
| ABL1 | 2025 | 2855166 | G | RECESSIVE | 0.0080620 | 1.58 |
| ABL1 | 2026 | 10793970 | C | RECESSIVE | 0.0095570 | 1.58 |
| ABL1 | 2027 | 2260323 | C | RECESSIVE | 0.0035922 | 0.39 |
| TSC1 | 2028 | 2072058 | A | RECESSIVE | 0.0218350 | 1.27 |
| TSC1 | 2029 | 1076160 | A | ADDITIVE | 0.0031707 | 1.20 |
| TSC1 | 2030 | 2106346 | C | ADDITIVE | 0.0038176 | 1.18 |
| VAV2 | 2034 | 3780737 | T | ADDITIVE | 0.0373574 | 1.21 |
| VAV2 | 2035 | 7038256 | T | DOMINANT | 0.0491421 | 1.23 |
| VAV2 | 2036 | 7025939 | C | DOMINANT | 0.0484149 | 1.23 |
| VAV2 | 2037 | 7852459 | C | ADDITIVE | 0.0374513 | 1.20 |
| KCNT1 | 2038 | 497547 | G | RECESSIVE | 0.0181664 | 8.29 |
| INPP5E | 2039 | 3812591 | C | RECESSIVE | 0.0392248 | 0.67 |
| NOTCH1 | 2040 | 3124596 | G | RECESSIVE | 0.0381242 | 0.81 |
| CACNA1B | 2047 | 2606356 | C | RECESSIVE | 0.0373269 | 0.70 |
| PRKCQ | 2050 | 7098118 | G | RECESSIVE | 0.0322084 | 0.80 |
| MYO3A | 2066 | 12413819 | G | ADDITIVE | 0.0465566 | 1.12 |
| MYO3A | 2067 | 10828913 | A | RECESSIVE | 0.0251933 | 0.79 |
| MYO3A | 2068 | 1339814 | T | ADDITIVE | 0.0285389 | 0.91 |
| MYO3A | 2069 | 1416860 | T | ADDITIVE | 0.0394525 | 0.91 |
| MYO3A | 2070 | 7899567 | A | ADDITIVE | 0.0356197 | 0.91 |
| MYO3A | 2071 | 11014934 | G | ADDITIVE | 0.0329156 | 0.90 |
| MYO3A | 2072 | 12246202 | C | ADDITIVE | 0.0336769 | 0.89 |
| MYO3A | 2073 | 12263990 | G | ADDITIVE | 0.0156424 | 0.89 |
| MYO3A | 2074 | 7095559 | A | ADDITIVE | 0.0254709 | 0.89 |
| MYO3A | 2075 | 12258453 | T | ADDITIVE | 0.0211277 | 0.89 |
| SLC18A3 | 2076 | 7072155 | A | ADDITIVE | 0.0302690 | 0.86 |
| SLC18A3 | 2077 | 3810947 | A | ADDITIVE | 0.0020366 | 0.61 |
| PRKG1 | 2078 | 6479874 | T | RECESSIVE | 0.0168037 | 0.48 |
| PRKG1 | 2079 | 1904701 | A | RECESSIVE | 0.0439780 | 1.24 |
| PRKG1 | 2080 | 1904693 | C | RECESSIVE | 0.0044438 | 0.74 |
| PRKG1 | 2081 | 1904692 | T | RECESSIVE | 0.0050777 | 0.74 |
| PRKG1 | 2082 | 7893773 | T | ADDITIVE | 0.0160324 | 0.91 |
| PRKG1 | 2083 | 1904683 | A | RECESSIVE | 0.0365828 | 0.79 |
| PRKG1 | 2087 | 10466032 | A | ADDITIVE | 0.0215148 | 1.12 |
| PRKG1 | 2088 | 7898110 | C | ADDITIVE | 0.0140078 | 1.13 |
| PCDH15 | 2089 | 7894926 | G | DOMINANT | 0.0278962 | 0.83 |
| PCDH15 | 2110 | 11004864 | A | RECESSIVE | 0.0029424 | 0.61 |
| PCDH15 | 2111 | 11004899 | C | ADDITIVE | 0.0265588 | 0.89 |
| PCDH15 | 2112 | 11817318 | T | RECESSIVE | 0.0075861 | 0.64 |
| PCDH15 | 2113 | 16907523 | G | RECESSIVE | 0.0055983 | 0.63 |
| ANK3 | 2114 | 4948381 | C | RECESSIVE | 0.0163307 | 1.42 |
| ANK3 | 2117 | 2393614 | T | DOMINANT | 0.0227626 | 1.22 |
| ANK3 | 2118 | 11814110 | A | DOMINANT | 0.0059685 | 1.28 |
| JMJD1C | 2121 | 10733789 | C | RECESSIVE | 0.0036418 | 1.53 |
| JMJD1C | 2122 | 10761739 | C | RECESSIVE | 0.0310920 | 1.27 |
| JMJD1C | 2123 | 10761741 | T | RECESSIVE | 0.0170313 | 1.31 |
| JMJD1C | 2125 | 10740118 | C | RECESSIVE | 0.0307258 | 1.27 |
| CTNNA3 | 2127 | 4746541 | G | ADDITIVE | 0.0377940 | 0.86 |
| CTNNA3 | 2128 | 10509256 | A | DOMINANT | 0.0105834 | 0.79 |
| CTNNA3 | 2130 | 1903881 | A | ADDITIVE | 0.0400313 | 0.84 |
| CTNNA3 | 2131 | 6480141 | T | ADDITIVE | 0.0172475 | 0.84 |
| CTNNA3 | 2132 | 10996932 | C | ADDITIVE | 0.0201696 | 0.84 |
| CTNNA3 | 2133 | 1462817 | A | ADDITIVE | 0.0458365 | 0.87 |
| CTNNA3 | 2134 | 1471383 | A | ADDITIVE | 0.0437793 | 0.88 |
| CTNNA3 | 2135 | 2893985 | C | ADDITIVE | 0.0403465 | 0.90 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| CTNNA3 | 2136 | 4578273 | T | RECESSIVE | 0.0343268 | 0.53 |
| CTNNA3 | 2138 | 12569810 | G | ADDITIVE | 0.0435631 | 0.87 |
| CTNNA3 | 2139 | 10997042 | G | ADDITIVE | 0.0449482 | 0.87 |
| CTNNA3 | 2145 | 6480253 | A | DOMINANT | 0.0370978 | 0.82 |
| CTNNA3 | 2146 | 1904633 | A | DOMINANT | 0.0239466 | 0.82 |
| CTNNA3 | 2147 | 2127595 | A | DOMINANT | 0.0242748 | 0.82 |
| CTNNA3 | 2148 | 7078583 | T | DOMINANT | 0.0272915 | 0.82 |
| CTNNA3 | 2149 | 1904653 | T | DOMINANT | 0.0316871 | 0.82 |
| CTNNA3 | 2150 | 1947842 | A | DOMINANT | 0.0389275 | 0.83 |
| CTNNA3 | 2151 | 10823003 | C | DOMINANT | 0.0204615 | 0.81 |
| CTNNA3 | 2152 | 7907339 | T | DOMINANT | 0.0146015 | 0.80 |
| CTNNA3 | 2153 | 1904645 | G | DOMINANT | 0.0209166 | 0.81 |
| CTNNA3 | 2156 | 10997759 | A | ADDITIVE | 0.0133316 | 0.82 |
| CTNNA3 | 2157 | 7076484 | A | ADDITIVE | 0.0270663 | 0.85 |
| CTNNA3 | 2158 | 4522060 | G | ADDITIVE | 0.0127013 | 0.83 |
| CTNNA3 | 2159 | 7076356 | A | ADDITIVE | 0.0213460 | 0.85 |
| CTNNA3 | 2160 | 7893446 | C | ADDITIVE | 0.0208959 | 0.87 |
| CTNNA3 | 2161 | 3125312 | A | DOMINANT | 0.0251542 | 0.82 |
| CTNNA3 | 2162 | 7072543 | G | ADDITIVE | 0.0115815 | 0.83 |
| CDH23 | 2163 | 2305210 | A | DOMINANT | 0.0449191 | 1.19 |
| KCNMA1 | 2164 | 846606 | T | DOMINANT | 0.0476626 | 1.20 |
| KCNMA1 | 2165 | 2569360 | C | ADDITIVE | 0.0027201 | 1.25 |
| KCNMA1 | 2166 | 2569361 | C | ADDITIVE | 0.0028000 | 1.25 |
| KCNMA1 | 2167 | 4980107 | C | ADDITIVE | 0.0034214 | 1.28 |
| KCNMA1 | 2168 | 10762731 | G | ADDITIVE | 0.0050389 | 1.25 |
| KCNMA1 | 2169 | 4980113 | C | ADDITIVE | 0.0082204 | 1.25 |
| KCNMA1 | 2170 | 10762732 | T | ADDITIVE | 0.0088407 | 1.23 |
| KCNMA1 | 2171 | 7086316 | G | RECESSIVE | 0.0044008 | 1.98 |
| KCNMA1 | 2172 | 10762740 | G | RECESSIVE | 0.0047376 | 1.73 |
| KCNMA1 | 2177 | 7078525 | T | RECESSIVE | 0.0298495 | 2.10 |
| KCNMA1 | 2178 | 11002054 | G | RECESSIVE | 0.0443400 | 1.87 |
| KCNMA1 | 2179 | 7071433 | A | ADDITIVE | 0.0146885 | 0.83 |
| KCNMA1 | 2180 | 7071575 | C | ADDITIVE | 0.0088199 | 0.80 |
| KCNMA1 | 2181 | 10824547 | T | DOMINANT | 0.0046037 | 0.75 |
| KCNMA1 | 2182 | 2673464 | A | ADDITIVE | 0.0258129 | 1.21 |
| NRG3 | 2183 | 11191281 | G | DOMINANT | 0.0223381 | 0.82 |
| NRG3 | 2187 | 474496 | G | ADDITIVE | 0.0141283 | 0.88 |
| NRG3 | 2188 | 495978 | A | RECESSIVE | 0.0424455 | 0.76 |
| SORBS1 | 2189 | 3193970 | G | ADDITIVE | 0.0403484 | 0.87 |
| SORBS1 | 2191 | 7904517 | C | DOMINANT | 0.0481906 | 0.84 |
| SORBS1 | 2192 | 4918918 | T | DOMINANT | 0.0465045 | 0.84 |
| SORBS1 | 2195 | 7086071 | A | RECESSIVE | 0.0402730 | 0.81 |
| PIK3AP1 | 2200 | 563654 | A | ADDITIVE | 0.0485542 | 1.20 |
| SLIT1 | 2201 | 2817688 | G | DOMINANT | 0.0477908 | 0.84 |
| SLIT1 | 2204 | 877825 | A | RECESSIVE | 0.0068247 | 1.49 |
| SLIT1 | 2205 | 1253425 | T | RECESSIVE | 0.0044443 | 1.53 |
| SORCS3 | 2206 | 10786806 | T | DOMINANT | 0.0230872 | 0.81 |
| SORCS3 | 2207 | 10884026 | G | DOMINANT | 0.0466766 | 0.83 |
| SORCS3 | 2212 | 2451484 | T | DOMINANT | 0.0204182 | 1.22 |
| SORCS3 | 2213 | 2451492 | T | DOMINANT | 0.0448306 | 1.19 |
| SORCS3 | 2214 | 2451498 | C | DOMINANT | 0.0394798 | 1.20 |
| VTI1A | 2218 | 10509963 | A | ADDITIVE | 0.0364346 | 1.15 |
| VTI1A | 2219 | 10885352 | A | ADDITIVE | 0.0312111 | 1.16 |
| ATRNL1 | 2220 | 1264764 | C | RECESSIVE | 0.0423769 | 1.44 |
| ATRNL1 | 2221 | 2165988 | A | RECESSIVE | 0.0263977 | 1.49 |
| ATRNL1 | 2222 | 659351 | C | ADDITIVE | 0.0425307 | 0.92 |
| ATRNL1 | 2226 | 11197258 | A | RECESSIVE | 0.0241968 | 1.27 |
| ATRNL1 | 2227 | 17724227 | G | RECESSIVE | 0.0486980 | 1.22 |
| ATRNL1 | 2229 | 11197299 | G | RECESSIVE | 0.0420227 | 1.23 |
| ATRNL1 | 2230 | 2804192 | A | DOMINANT | 0.0465215 | 0.83 |
| ATRNL1 | 2232 | 2804204 | T | DOMINANT | 0.0452295 | 0.82 |
| ATRNL1 | 2233 | 2804207 | C | DOMINANT | 0.0446262 | 0.82 |
| ATRNL1 | 2234 | 1590734 | G | DOMINANT | 0.0220684 | 0.80 |
| ATRNL1 | 2235 | 1590733 | G | DOMINANT | 0.0271440 | 0.81 |
| ATRNL1 | 2236 | 10787584 | T | DOMINANT | 0.0300612 | 0.81 |
| ATRNL1 | 2237 | 11197337 | T | DOMINANT | 0.0247875 | 0.80 |
| ATRNL1 | 2238 | 2804249 | G | DOMINANT | 0.0261977 | 0.81 |
| ATRNL1 | 2239 | 2420098 | G | DOMINANT | 0.0258332 | 0.81 |
| ATRNL1 | 2240 | 2615886 | T | DOMINANT | 0.0213907 | 0.81 |
| GRK5 | 2245 | 12783252 | A | DOMINANT | 0.0293098 | 1.26 |
| ATE1 | 2246 | 9971131 | G | RECESSIVE | 0.0322772 | 1.28 |
| ATE1 | 2247 | 1693688 | C | RECESSIVE | 0.0110052 | 1.39 |
| ATE1 | 2248 | 1696853 | T | RECESSIVE | 0.0190620 | 1.32 |
| ATE1 | 2249 | 2935718 | C | RECESSIVE | 0.0165139 | 1.33 |
| ATE1 | 2250 | 1693687 | C | RECESSIVE | 0.0213620 | 1.31 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| ATE1 | 2251 | 7086628 | G | ADDITIVE | 0.0298710 | 1.12 |
| ATE1 | 2253 | 753455 | C | ADDITIVE | 0.0240211 | 0.81 |
| ATE1 | 2254 | 3862129 | C | RECESSIVE | 0.0160747 | 1.82 |
| ATE1 | 2255 | 11200201 | C | RECESSIVE | 0.0250409 | 1.70 |
| ATE1 | 2257 | 7907871 | A | RECESSIVE | 0.0077470 | 2.10 |
| ATE1 | 2258 | 12245528 | C | RECESSIVE | 0.0170905 | 1.78 |
| ATE1 | 2259 | 11818001 | A | RECESSIVE | 0.0154840 | 1.79 |
| ATE1 | 2260 | 10510101 | A | RECESSIVE | 0.0127797 | 1.82 |
| ATE1 | 2261 | 12253283 | A | RECESSIVE | 0.0121793 | 1.82 |
| ATE1 | 2262 | 11200257 | A | RECESSIVE | 0.0126460 | 1.82 |
| ATE1 | 2263 | 11200260 | T | RECESSIVE | 0.0126460 | 1.82 |
| EBF3 | 2264 | 11016947 | T | ADDITIVE | 0.0249669 | 0.87 |
| DEAF1 | 2267 | 10902209 | A | RECESSIVE | 0.0407650 | 1.49 |
| CEND1 | 2268 | 11823172 | A | ADDITIVE | 0.0447735 | 1.12 |
| TRIM21 | 2280 | 2599586 | G | ADDITIVE | 0.0496600 | 1.09 |
| GALNTL4 | 2282 | 12224023 | C | RECESSIVE | 0.0315983 | 0.76 |
| GALNTL4 | 2283 | 901553 | C | DOMINANT | 0.0400766 | 0.84 |
| GALNTL4 | 2284 | 11021956 | C | ADDITIVE | 0.0036817 | 1.23 |
| GALNTL4 | 2285 | 7484121 | A | ADDITIVE | 0.0262693 | 1.12 |
| SPON1 | 2291 | 2697852 | G | RECESSIVE | 0.0314548 | 1.43 |
| SPON1 | 2292 | 1969542 | C | RECESSIVE | 0.0068803 | 1.46 |
| SPON1 | 2303 | 12283632 | A | RECESSIVE | 0.0211452 | 1.43 |
| SPON1 | 2304 | 11023067 | G | RECESSIVE | 0.0314589 | 1.39 |
| SPON1 | 2309 | 1864658 | C | RECESSIVE | 0.0225521 | 1.38 |
| SPON1 | 2310 | 4757244 | A | RECESSIVE | 0.0161609 | 1.41 |
| SPON1 | 2311 | 2303974 | A | RECESSIVE | 0.0392525 | 1.34 |
| SERGEF | 2319 | 999420 | T | ADDITIVE | 0.0259634 | 0.91 |
| SERGEF | 2320 | 4757589 | C | ADDITIVE | 0.0241152 | 0.88 |
| SERGEF | 2321 | 2299634 | C | DOMINANT | 0.0470294 | 1.20 |
| IGSF22 | 2322 | 9705036 | T | RECESSIVE | 0.0454089 | 0.73 |
| IGSF22 | 2325 | 4537730 | A | DOMINANT | 0.0307116 | 1.20 |
| PTPN5 | 2326 | 4757710 | A | DOMINANT | 0.0068522 | 1.26 |
| PTPN5 | 2327 | 4757711 | T | DOMINANT | 0.0101211 | 1.25 |
| PTPN5 | 2328 | 11024782 | T | DOMINANT | 0.0108359 | 1.24 |
| PTPN5 | 2329 | 4757718 | G | RECESSIVE | 0.0044080 | 1.45 |
| NAV2 | 2331 | 1559665 | G | RECESSIVE | 0.0079769 | 1.30 |
| NAV2 | 2333 | 1035700 | T | RECESSIVE | 0.0146450 | 1.28 |
| NAV2 | 2339 | 12807015 | T | RECESSIVE | 0.0466472 | 0.81 |
| LRRC4C | 2362 | 976933 | G | ADDITIVE | 0.0151178 | 0.83 |
| LRRC4C | 2363 | 7925066 | T | ADDITIVE | 0.0223300 | 0.84 |
| LRRC4C | 2364 | 1452478 | G | ADDITIVE | 0.0137950 | 0.77 |
| LRRC4C | 2365 | 6485190 | A | ADDITIVE | 0.0341935 | 0.81 |
| LRRC4C | 2366 | 721587 | A | ADDITIVE | 0.0202120 | 0.76 |
| LRRC4C | 2367 | 1470817 | G | ADDITIVE | 0.0230646 | 0.83 |
| LRRC4C | 2368 | 1452474 | C | ADDITIVE | 0.0215748 | 0.84 |
| LRRC4C | 2369 | 1452473 | C | ADDITIVE | 0.0292250 | 0.79 |
| LRRC4C | 2370 | 10837372 | T | ADDITIVE | 0.0142079 | 0.77 |
| LRRC4C | 2371 | 1452466 | C | ADDITIVE | 0.0290746 | 0.79 |
| LRRC4C | 2373 | 10501227 | G | ADDITIVE | 0.0128450 | 0.77 |
| LRRC4C | 2374 | 1452485 | A | ADDITIVE | 0.0172530 | 0.79 |
| PHACS | 2376 | 16937817 | G | ADDITIVE | 0.0225850 | 0.83 |
| PHACS | 2379 | 7950395 | T | ADDITIVE | 0.0093959 | 0.83 |
| PHACS | 2382 | 11037858 | A | RECESSIVE | 0.0140017 | 1.64 |
| SYT13 | 2383 | 2863174 | C | RECESSIVE | 0.0224882 | 2.71 |
| SYT13 | 2384 | 6485604 | T | RECESSIVE | 0.0224882 | 2.71 |
| SYT13 | 2385 | 6416130 | A | ADDITIVE | 0.0451255 | 1.15 |
| SYT13 | 2386 | 12362429 | G | ADDITIVE | 0.0337908 | 1.17 |
| SYT13 | 2387 | 12362444 | G | ADDITIVE | 0.0365689 | 1.17 |
| SYT13 | 2388 | 1000665 | C | DOMINANT | 0.0097587 | 1.28 |
| SYT13 | 2389 | 7124508 | T | DOMINANT | 0.0192891 | 1.24 |
| CTNND1 | 2390 | 576859 | A | RECESSIVE | 0.0449124 | 0.73 |
| CTNND1 | 2391 | 2956981 | A | DOMINANT | 0.0262929 | 1.23 |
| CTNND1 | 2392 | 11570181 | C | DOMINANT | 0.0375459 | 1.21 |
| CTNND1 | 2393 | 606499 | G | DOMINANT | 0.0419198 | 1.21 |
| CTNND1 | 2394 | 1786438 | T | DOMINANT | 0.0220739 | 1.24 |
| CTNND1 | 2395 | 585337 | C | DOMINANT | 0.0490368 | 1.20 |
| CTNND1 | 2396 | 10750870 | A | DOMINANT | 0.0437290 | 1.20 |
| DLG2 | 2397 | 1075719 | G | ADDITIVE | 0.0463368 | 0.90 |
| DLG2 | 2398 | 10501540 | G | ADDITIVE | 0.0071038 | 0.85 |
| DLG2 | 2399 | 11233641 | G | DOMINANT | 0.0091873 | 0.80 |
| DLG2 | 2400 | 7116939 | C | DOMINANT | 0.0180733 | 0.82 |
| DLG2 | 2401 | 10898133 | A | ADDITIVE | 0.0138623 | 0.83 |
| DLG2 | 2402 | 6592120 | G | ADDITIVE | 0.0238984 | 0.86 |
| DLG2 | 2403 | 7113167 | C | ADDITIVE | 0.0169090 | 0.85 |
| DLG2 | 2404 | 515618 | C | ADDITIVE | 0.0351546 | 0.89 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| DLG2 | 2405 | 635823 | G | ADDITIVE | 0.0224424 | 0.88 |
| DLG2 | 2406 | 489567 | C | ADDITIVE | 0.0339389 | 0.92 |
| DLG2 | 2407 | 1367980 | G | ADDITIVE | 0.0001342 | 1.25 |
| DLG2 | 2408 | 4480567 | C | ADDITIVE | 0.0001111 | 1.26 |
| DLG2 | 2409 | 2060147 | G | ADDITIVE | 0.0000526 | 1.28 |
| DLG2 | 2410 | 983590 | T | ADDITIVE | 0.0002851 | 1.26 |
| DLG2 | 2411 | 11233711 | T | ADDITIVE | 0.0007972 | 1.26 |
| DLG2 | 2412 | 12225388 | A | ADDITIVE | 0.0006237 | 1.26 |
| DLG2 | 2413 | 10898148 | A | ADDITIVE | 0.0003065 | 1.34 |
| DLG2 | 2414 | 12222455 | A | ADDITIVE | 0.0012133 | 1.23 |
| DLG2 | 2415 | 10898152 | C | ADDITIVE | 0.0009121 | 1.18 |
| DLG2 | 2416 | 7950988 | T | ADDITIVE | 0.0007903 | 1.25 |
| DLG2 | 2417 | 1945309 | A | ADDITIVE | 0.0042119 | 1.24 |
| DLG2 | 2418 | 10898301 | A | ADDITIVE | 0.0422705 | 0.90 |
| OPCML | 2424 | 1894193 | C | DOMINANT | 0.0428955 | 0.83 |
| OPCML | 2425 | 7119286 | T | RECESSIVE | 0.0349083 | 1.23 |
| OPCML | 2426 | 10791288 | G | RECESSIVE | 0.0423356 | 0.80 |
| OPCML | 2427 | 2155777 | A | RECESSIVE | 0.0480178 | 1.73 |
| TSPAN9 | 2434 | 650180 | T | RECESSIVE | 0.0274779 | 0.77 |
| TSPAN9 | 2435 | 544668 | G | RECESSIVE | 0.0448808 | 0.79 |
| TMEM16B | 2436 | 2159952 | A | ADDITIVE | 0.0117685 | 0.84 |
| TMEM16B | 2438 | 3782652 | G | DOMINANT | 0.0205163 | 0.79 |
| TMEM16B | 2439 | 735393 | A | ADDITIVE | 0.0048766 | 0.83 |
| TMEM16B | 2440 | 2277403 | G | DOMINANT | 0.0328471 | 0.81 |
| TMEM16B | 2441 | 11832095 | A | DOMINANT | 0.0051263 | 0.78 |
| TMEM16B | 2442 | 11063875 | T | DOMINANT | 0.0038849 | 0.78 |
| PIK3C2G | 2461 | 4471494 | C | DOMINANT | 0.0312098 | 0.76 |
| PIK3C2G | 2462 | 7968533 | C | DOMINANT | 0.0267659 | 0.75 |
| PIK3C2G | 2464 | 10841059 | A | DOMINANT | 0.0326190 | 0.83 |
| ITPR2 | 2466 | 9442 | T | DOMINANT | 0.0464723 | 0.84 |
| ITPR2 | 2467 | 2570 | C | DOMINANT | 0.0243506 | 0.82 |
| ITPR2 | 2468 | 7955049 | G | DOMINANT | 0.0290689 | 0.82 |
| CNOT2 | 2476 | 7312236 | C | RECESSIVE | 0.0187919 | 0.66 |
| KCNC2 | 2478 | 4309217 | A | RECESSIVE | 0.0489126 | 1.34 |
| KCNC2 | 2479 | 4131954 | T | RECESSIVE | 0.0463830 | 1.36 |
| KCNC2 | 2480 | 2471653 | T | ADDITIVE | 0.0255763 | 1.12 |
| NAV3 | 2481 | 300447 | C | DOMINANT | 0.0466417 | 1.19 |
| NAV3 | 2482 | 2694667 | A | ADDITIVE | 0.0174834 | 1.18 |
| NAV3 | 2483 | 1375287 | C | DOMINANT | 0.0454615 | 1.19 |
| GAS2L3 | 2484 | 35716 | A | DOMINANT | 0.0078126 | 0.78 |
| GAS2L3 | 2485 | 35714 | T | DOMINANT | 0.0151061 | 0.79 |
| GAS2L3 | 2486 | 35711 | G | DOMINANT | 0.0155281 | 0.80 |
| CHST11 | 2488 | 2453161 | G | RECESSIVE | 0.0303619 | 0.71 |
| CHST11 | 2490 | 2642109 | T | RECESSIVE | 0.0322027 | 0.74 |
| CHST11 | 2491 | 1565815 | T | RECESSIVE | 0.0076800 | 0.66 |
| CHST11 | 2492 | 1038968 | C | RECESSIVE | 0.0117274 | 0.69 |
| CHST11 | 2493 | 2696006 | T | RECESSIVE | 0.0076488 | 0.66 |
| CHST11 | 2494 | 2463017 | C | RECESSIVE | 0.0052053 | 0.65 |
| CHST11 | 2495 | 2468082 | G | RECESSIVE | 0.0199536 | 0.72 |
| CHST11 | 2496 | 2468083 | A | RECESSIVE | 0.0209249 | 0.69 |
| KIAA1853 | 2497 | 7134748 | G | DOMINANT | 0.0081069 | 0.80 |
| KIAA1853 | 2498 | 7298308 | C | DOMINANT | 0.0183467 | 0.81 |
| KIAA1853 | 2499 | 11064675 | C | RECESSIVE | 0.0344640 | 1.43 |
| KIAA1853 | 2500 | 7136574 | T | DOMINANT | 0.0268004 | 0.82 |
| KIAA1853 | 2501 | 4075945 | T | DOMINANT | 0.0335334 | 0.78 |
| KIAA1853 | 2502 | 4075946 | T | RECESSIVE | 0.0013569 | 1.38 |
| PLA2G1B | 2503 | 5637 | A | ADDITIVE | 0.0455980 | 0.87 |
| RIMBP2 | 2504 | 7132917 | A | DOMINANT | 0.0315735 | 0.69 |
| STX2 | 2507 | 1554807 | T | ADDITIVE | 0.0488395 | 1.13 |
| STX2 | 2508 | 7975825 | C | ADDITIVE | 0.0443082 | 1.14 |
| STX2 | 2509 | 4619189 | T | DOMINANT | 0.0275395 | 1.23 |
| STX2 | 2510 | 7956851 | C | ADDITIVE | 0.0391212 | 1.14 |
| KIAA1545 | 2511 | 3751309 | G | DOMINANT | 0.0019743 | 1.37 |
| KIAA1545 | 2512 | 11208 | C | DOMINANT | 0.0287632 | 1.22 |
| MTIF3 | 2513 | 2892058 | G | DOMINANT | 0.0254705 | 0.58 |
| MTIF3 | 2514 | 17085657 | C | DOMINANT | 0.0390401 | 0.63 |
| UBL3 | 2516 | 11618361 | A | RECESSIVE | 0.0202510 | 0.77 |
| N4BP2L2 | 2517 | 206335 | C | RECESSIVE | 0.0320207 | 0.79 |
| NBEA | 2520 | 1148328 | C | DOMINANT | 0.0464549 | 1.30 |
| NBEA | 2521 | 2247674 | A | DOMINANT | 0.0475123 | 1.28 |
| NBEA | 2522 | 2243774 | C | DOMINANT | 0.0173986 | 1.25 |
| NBEA | 2523 | 499570 | A | DOMINANT | 0.0449816 | 1.28 |
| NBEA | 2525 | 9315346 | T | DOMINANT | 0.0266363 | 0.82 |
| NBEA | 2526 | 7333195 | T | DOMINANT | 0.0225556 | 0.82 |
| NBEA | 2527 | 3794394 | G | DOMINANT | 0.0195103 | 0.81 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| TRPC4 | 2528 | 7319022 | A | DOMINANT | 0.0378172 | 1.21 |
| TRPC4 | 2529 | 1556541 | C | DOMINANT | 0.0048620 | 1.29 |
| TRPC4 | 2530 | 12858218 | A | RECESSIVE | 0.0252777 | 0.79 |
| TRPC4 | 2531 | 9548043 | G | DOMINANT | 0.0015744 | 1.32 |
| TRPC4 | 2532 | 1759875 | G | DOMINANT | 0.0182381 | 0.80 |
| KPNA3 | 2536 | 9526614 | G | DOMINANT | 0.0059645 | 0.78 |
| PCDH17 | 2538 | 9527675 | G | RECESSIVE | 0.0155568 | 1.37 |
| PCDH17 | 2539 | 9527676 | G | RECESSIVE | 0.0111272 | 1.38 |
| PCDH17 | 2540 | 2592866 | A | DOMINANT | 0.0392094 | 1.21 |
| PCDH17 | 2541 | 17175693 | A | DOMINANT | 0.0243714 | 1.23 |
| PCDH20 | 2542 | 9539153 | T | RECESSIVE | 0.0101180 | 0.57 |
| LMO7 | 2545 | 579540 | C | ADDITIVE | 0.0227271 | 1.24 |
| LMO7 | 2546 | 2273996 | T | ADDITIVE | 0.0331422 | 1.17 |
| SLAIN1 | 2547 | 2813740 | T | ADDITIVE | 0.0261869 | 0.84 |
| SLAIN1 | 2548 | 9530678 | A | ADDITIVE | 0.0182447 | 0.83 |
| SLAIN1 | 2549 | 9593251 | T | ADDITIVE | 0.0113857 | 0.90 |
| SLAIN1 | 2550 | 7997533 | G | ADDITIVE | 0.0047501 | 0.80 |
| SLAIN1 | 2551 | 9600917 | C | ADDITIVE | 0.0045485 | 0.82 |
| SLAIN1 | 2552 | 1279446 | C | ADDITIVE | 0.0063095 | 0.85 |
| GPC5 | 2554 | 9523304 | A | RECESSIVE | 0.0068650 | 1.37 |
| GPC5 | 2555 | 7322734 | A | RECESSIVE | 0.0073729 | 1.37 |
| GPC5 | 2556 | 4142965 | C | RECESSIVE | 0.0133525 | 1.31 |
| GPC5 | 2557 | 9523312 | G | RECESSIVE | 0.0057670 | 1.38 |
| GPC5 | 2558 | 8002779 | G | RECESSIVE | 0.0079325 | 1.36 |
| GPC5 | 2561 | 17267257 | C | RECESSIVE | 0.0359110 | 1.34 |
| GPC5 | 2563 | 10507993 | G | ADDITIVE | 0.0409083 | 1.12 |
| GPC6 | 2566 | 9561374 | T | ADDITIVE | 0.0252836 | 1.11 |
| GPC6 | 2567 | 3899317 | A | DOMINANT | 0.0470229 | 0.83 |
| GPC6 | 2568 | 1330620 | A | DOMINANT | 0.0292062 | 0.83 |
| GPC6 | 2569 | 9589816 | A | DOMINANT | 0.0490167 | 0.84 |
| GPC6 | 2570 | 4394948 | C | DOMINANT | 0.0233102 | 0.82 |
| GPC6 | 2571 | 7987964 | T | DOMINANT | 0.0191043 | 0.82 |
| GPC6 | 2572 | 7993501 | C | DOMINANT | 0.0251535 | 0.82 |
| GPC6 | 2573 | 9584153 | C | DOMINANT | 0.0226752 | 0.82 |
| GPC6 | 2574 | 9561444 | T | ADDITIVE | 0.0342887 | 0.86 |
| GPC6 | 2575 | 885192 | G | ADDITIVE | 0.0383759 | 0.85 |
| GPC6 | 2576 | 3759423 | A | ADDITIVE | 0.0404510 | 0.87 |
| GPC6 | 2577 | 3759422 | A | ADDITIVE | 0.0317214 | 0.85 |
| GPC6 | 2578 | 4486746 | T | ADDITIVE | 0.0304719 | 0.87 |
| GPC6 | 2579 | 9556328 | T | ADDITIVE | 0.0342887 | 0.86 |
| GPC6 | 2580 | 7317144 | A | ADDITIVE | 0.0284312 | 0.85 |
| GPC6 | 2581 | 2150124 | T | ADDITIVE | 0.0198515 | 0.85 |
| GPC6 | 2582 | 2892667 | G | ADDITIVE | 0.0185626 | 0.87 |
| GPC6 | 2583 | 1411507 | C | ADDITIVE | 0.0183944 | 0.86 |
| GPC6 | 2584 | 1983987 | A | ADDITIVE | 0.0168726 | 0.85 |
| GPC6 | 2585 | 2183430 | T | ADDITIVE | 0.0232996 | 0.85 |
| GPC6 | 2586 | 1411513 | T | ADDITIVE | 0.0201909 | 0.85 |
| GPC6 | 2587 | 9301916 | C | ADDITIVE | 0.0136589 | 0.87 |
| GPC6 | 2588 | 9524268 | T | ADDITIVE | 0.0203651 | 0.87 |
| GPC6 | 2589 | 9301957 | A | RECESSIVE | 0.0278119 | 0.66 |
| NALCN | 2601 | 7992226 | G | RECESSIVE | 0.0147207 | 1.42 |
| NALCN | 2602 | 570252 | C | RECESSIVE | 0.0092784 | 1.30 |
| FGF14 | 2614 | 12870187 | T | RECESSIVE | 0.0144408 | 0.73 |
| TTC5 | 2616 | 4981948 | C | ADDITIVE | 0.0220117 | 1.21 |
| TTC5 | 2617 | 3737220 | A | ADDITIVE | 0.0147145 | 1.20 |
| TTC5 | 2618 | 4981951 | C | ADDITIVE | 0.0450037 | 1.17 |
| TTC5 | 2619 | 1953552 | A | ADDITIVE | 0.0374421 | 0.84 |
| TTC5 | 2620 | 2318864 | G | DOMINANT | 0.0292801 | 1.21 |
| TTC5 | 2621 | 3742945 | A | DOMINANT | 0.0472652 | 1.19 |
| TTC5 | 2622 | 10873395 | T | DOMINANT | 0.0347043 | 1.20 |
| TEP1 | 2623 | 1760904 | C | ADDITIVE | 0.0020357 | 1.21 |
| TEP1 | 2624 | 1713458 | T | DOMINANT | 0.0048196 | 1.32 |
| TEP1 | 2625 | 1760903 | T | ADDITIVE | 0.0024041 | 1.27 |
| TEP1 | 2626 | 1713440 | T | RECESSIVE | 0.0225677 | 1.34 |
| NOVA1 | 2630 | 8008779 | C | RECESSIVE | 0.0409157 | 0.61 |
| SLC25A21 | 2633 | 7359156 | G | DOMINANT | 0.0248664 | 0.82 |
| SLC25A21 | 2634 | 1884777 | T | ADDITIVE | 0.0250316 | 1.25 |
| GNG2 | 2644 | 8014746 | G | ADDITIVE | 0.0124262 | 0.82 |
| GNG2 | 2645 | 8019331 | A | ADDITIVE | 0.0232918 | 0.85 |
| GNG2 | 2646 | 8008081 | A | ADDITIVE | 0.0324350 | 0.86 |
| DAAM1 | 2651 | 10873113 | T | RECESSIVE | 0.0181338 | 0.53 |
| DAAM1 | 2652 | 10483710 | A | RECESSIVE | 0.0259872 | 0.55 |
| PPP2R5E | 2663 | 6573522 | A | RECESSIVE | 0.0329840 | 1.41 |
| PPP2R5E | 2664 | 2754223 | G | RECESSIVE | 0.0468080 | 1.37 |
| PPP2R5E | 2666 | 964954 | G | RECESSIVE | 0.0214470 | 1.44 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| PPP2R5E | 2667 | 1255771 | G | RECESSIVE | 0.0163658 | 1.53 |
| PPP2R5E | 2670 | 7156393 | T | RECESSIVE | 0.0304882 | 4.73 |
| RGS6 | 2671 | 8003168 | A | ADDITIVE | 0.0272940 | 0.85 |
| RGS6 | 2672 | 11629078 | G | ADDITIVE | 0.0102800 | 0.86 |
| RGS6 | 2674 | 12894979 | G | DOMINANT | 0.0192980 | 0.79 |
| RGS6 | 2675 | 10149098 | G | DOMINANT | 0.0067421 | 0.79 |
| RGS6 | 2676 | 4903003 | G | DOMINANT | 0.0232287 | 0.80 |
| RGS6 | 2677 | 2139594 | G | DOMINANT | 0.0372164 | 0.82 |
| RGS6 | 2678 | 8007922 | G | DOMINANT | 0.0371972 | 0.82 |
| RGS6 | 2679 | 740337 | C | DOMINANT | 0.0402133 | 0.83 |
| RGS6 | 2680 | 2681754 | A | DOMINANT | 0.0263361 | 0.81 |
| RGS6 | 2681 | 2283380 | T | ADDITIVE | 0.0044408 | 0.84 |
| RGS6 | 2682 | 4903024 | T | RECESSIVE | 0.0037284 | 0.64 |
| RGS6 | 2683 | 2074953 | G | ADDITIVE | 0.0110725 | 0.86 |
| RGS6 | 2684 | 2239272 | G | ADDITIVE | 0.0110812 | 0.90 |
| KCNK10 | 2688 | 17771758 | G | RECESSIVE | 0.0230278 | 0.72 |
| KCNK10 | 2689 | 2223933 | C | RECESSIVE | 0.0225705 | 0.72 |
| KCNK10 | 2690 | 1950279 | T | RECESSIVE | 0.0225705 | 0.72 |
| KCNK10 | 2691 | 11628680 | G | RECESSIVE | 0.0238746 | 0.72 |
| KCNK10 | 2692 | 11844638 | T | RECESSIVE | 0.0138222 | 0.70 |
| KCNK10 | 2693 | 17698533 | C | RECESSIVE | 0.0010514 | 0.60 |
| KCNK10 | 2694 | 12185033 | T | ADDITIVE | 0.0298994 | 0.92 |
| KCNK13 | 2695 | 12432204 | G | ADDITIVE | 0.0082331 | 1.22 |
| KCNK13 | 2696 | 12894287 | T | DOMINANT | 0.0070356 | 1.27 |
| KCNK13 | 2697 | 12885846 | T | ADDITIVE | 0.0181878 | 1.16 |
| CCDC88C | 2700 | 1970912 | T | RECESSIVE | 0.0427118 | 1.25 |
| CCDC88C | 2701 | 17127245 | A | ADDITIVE | 0.0000056 | 1.98 |
| CCDC88C | 2702 | 1046311 | C | RECESSIVE | 0.0126923 | 0.51 |
| CCDC88C | 2703 | 8015982 | C | RECESSIVE | 0.0354492 | 0.67 |
| CCDC88C | 2704 | 10131741 | G | RECESSIVE | 0.0461950 | 0.68 |
| CCDC88C | 2705 | 8008996 | T | RECESSIVE | 0.0344292 | 0.66 |
| CCDC88C | 2706 | 8007791 | A | RECESSIVE | 0.0354492 | 0.67 |
| CCDC88C | 2709 | 11160006 | C | DOMINANT | 0.0137069 | 1.26 |
| ATP10A | 2711 | 12592145 | T | RECESSIVE | 0.0186787 | 0.25 |
| ATP10A | 2712 | 17555920 | T | RECESSIVE | 0.0300942 | >5 |
| ATP10A | 2713 | 17116015 | A | RECESSIVE | 0.0423953 | 0.33 |
| ATP10A | 2714 | 17555995 | C | RECESSIVE | 0.0299790 | >5 |
| ATP10A | 2715 | 2066703 | T | RECESSIVE | 0.0411497 | 0.23 |
| ATP10A | 2716 | 11637231 | G | RECESSIVE | 0.0308049 | 0.73 |
| ATP10A | 2717 | 9888671 | T | RECESSIVE | 0.0272411 | 0.45 |
| RYR3 | 2718 | 2596229 | A | DOMINANT | 0.0252864 | 1.24 |
| RYR3 | 2719 | 1560968 | G | DOMINANT | 0.0080819 | 1.28 |
| RYR3 | 2720 | 2676085 | A | DOMINANT | 0.0242734 | 1.22 |
| RYR3 | 2721 | 2676087 | A | DOMINANT | 0.0031600 | 1.34 |
| RYR3 | 2722 | 2164249 | C | DOMINANT | 0.0138068 | 1.26 |
| RYR3 | 2723 | 2596159 | T | DOMINANT | 0.0075480 | 1.29 |
| RYR3 | 2724 | 2596163 | G | DOMINANT | 0.0077911 | 1.28 |
| RYR3 | 2726 | 2082753 | A | DOMINANT | 0.0165656 | 1.25 |
| RYR3 | 2727 | 2572175 | A | DOMINANT | 0.0361360 | 1.23 |
| RYR3 | 2728 | 2572169 | A | DOMINANT | 0.0327803 | 1.22 |
| RYR3 | 2729 | 2596175 | A | DOMINANT | 0.0311287 | 1.23 |
| RYR3 | 2731 | 11853872 | A | DOMINANT | 0.0228117 | 0.76 |
| RYR3 | 2733 | 6495228 | G | DOMINANT | 0.0099332 | 1.28 |
| C15ORF41 | 2735 | 7183415 | C | RECESSIVE | 0.0249613 | 3.08 |
| RASGRP1 | 2746 | 17651741 | A | DOMINANT | 0.0290584 | 1.21 |
| UNC13C | 2749 | 2163195 | A | DOMINANT | 0.0074064 | 0.79 |
| UNC13C | 2750 | 2115825 | A | DOMINANT | 0.0296225 | 0.80 |
| UNC13C | 2751 | 8024845 | G | DOMINANT | 0.0017932 | 0.76 |
| UNC13C | 2752 | 1897013 | G | ADDITIVE | 0.0259308 | 0.83 |
| UNC13C | 2753 | 1864416 | T | ADDITIVE | 0.0235201 | 0.83 |
| UNC13C | 2754 | 11636356 | T | ADDITIVE | 0.0215324 | 0.83 |
| UNC13C | 2755 | 934192 | A | ADDITIVE | 0.0133643 | 0.82 |
| UNC13C | 2767 | 9920150 | G | RECESSIVE | 0.0411190 | 2.84 |
| NEDD4 | 2768 | 10518828 | A | RECESSIVE | 0.0234715 | 0.13 |
| CGNL1 | 2771 | 17820281 | A | RECESSIVE | 0.0053568 | 0.60 |
| GRINL1A | 2772 | 9920308 | A | RECESSIVE | 0.0328098 | 0.78 |
| GRINL1A | 2773 | 9920106 | T | ADDITIVE | 0.0126832 | 0.87 |
| GRINL1A | 2774 | 16953342 | C | RECESSIVE | 0.0412209 | 0.79 |
| GRINL1A | 2775 | 16977629 | T | DOMINANT | 0.0086808 | 0.69 |
| GRINL1A | 2776 | 16977631 | C | DOMINANT | 0.0143872 | 0.77 |
| ADAM10 | 2779 | 2414607 | A | ADDITIVE | 0.0252614 | 1.19 |
| CLK3 | 2781 | 2068982 | A | DOMINANT | 0.0351073 | 0.80 |
| ARNT2 | 2786 | 7172548 | T | RECESSIVE | 0.0339851 | 0.70 |
| ARNT2 | 2787 | 4459508 | A | RECESSIVE | 0.0222836 | 0.67 |
| AKAP13 | 2790 | 17623915 | C | RECESSIVE | 0.0382878 | 1.55 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| AKAP13 | 2803 | 8041467 | A | RECESSIVE | 0.0362968 | 0.75 |
| AKAP13 | 2806 | 11638762 | T | DOMINANT | 0.0384566 | 1.21 |
| AKAP13 | 2809 | 338515 | C | RECESSIVE | 0.0413126 | 0.23 |
| SV2B | 2816 | 2239994 | A | DOMINANT | 0.0147181 | 0.77 |
| SLCO3A1 | 2817 | 8037251 | T | RECESSIVE | 0.0417847 | 1.39 |
| SLCO3A1 | 2818 | 207970 | T | ADDITIVE | 0.0381480 | 1.13 |
| SLCO3A1 | 2819 | 7175812 | C | RECESSIVE | 0.0047319 | 0.35 |
| IGF1R | 2823 | 1574213 | A | RECESSIVE | 0.0270750 | 0.63 |
| IGF1R | 2824 | 11854132 | A | RECESSIVE | 0.0238766 | 0.68 |
| IGF1R | 2825 | 7170035 | G | RECESSIVE | 0.0201919 | 0.61 |
| A2BP1 | 2828 | 12445131 | C | RECESSIVE | 0.0445886 | 2.61 |
| A2BP1 | 2832 | 12600141 | T | DOMINANT | 0.0068865 | 0.79 |
| A2BP1 | 2833 | 7191740 | C | ADDITIVE | 0.0280927 | 0.85 |
| A2BP1 | 2834 | 17144423 | T | DOMINANT | 0.0421914 | 0.83 |
| A2BP1 | 2835 | 2079753 | T | DOMINANT | 0.0075058 | 0.79 |
| TMC5 | 2837 | 1985395 | C | RECESSIVE | 0.0063044 | 0.66 |
| TMC5 | 2838 | 7198723 | C | RECESSIVE | 0.0496953 | 0.66 |
| GOT2 | 2842 | 30842 | T | DOMINANT | 0.0187610 | 1.22 |
| GOT2 | 2843 | 257634 | C | DOMINANT | 0.0091372 | 1.26 |
| GOT2 | 2844 | 257637 | T | DOMINANT | 0.0086536 | 1.26 |
| GOT2 | 2845 | 171786 | T | DOMINANT | 0.0066105 | 1.27 |
| GOT2 | 2846 | 257621 | C | DOMINANT | 0.0092573 | 1.26 |
| GOT2 | 2847 | 185397 | T | DOMINANT | 0.0076979 | 1.26 |
| GOT2 | 2848 | 11076262 | G | DOMINANT | 0.0133323 | 1.24 |
| GOT2 | 2849 | 6499976 | A | DOMINANT | 0.0121080 | 1.24 |
| GOT2 | 2850 | 1595181 | A | DOMINANT | 0.0065869 | 1.27 |
| GOT2 | 2851 | 10852565 | C | DOMINANT | 0.0139807 | 1.24 |
| GOT2 | 2852 | 4784986 | T | DOMINANT | 0.0134433 | 1.24 |
| GOT2 | 2853 | 6416775 | C | DOMINANT | 0.0491326 | 1.21 |
| PLCG2 | 2858 | 9646328 | G | RECESSIVE | 0.0203369 | 0.77 |
| MPHOSPH6 | 2859 | 12149621 | T | DOMINANT | 0.0320370 | 0.82 |
| MPHOSPH6 | 2860 | 4889467 | C | ADDITIVE | 0.0142780 | 0.89 |
| MPHOSPH6 | 2861 | 2081257 | G | RECESSIVE | 0.0154834 | 0.34 |
| MPHOSPH6 | 2862 | 4889476 | G | ADDITIVE | 0.0065039 | 0.88 |
| MPHOSPH6 | 2863 | 2967355 | A | ADDITIVE | 0.0477083 | 0.91 |
| MPHOSPH6 | 2864 | 2967370 | A | RECESSIVE | 0.0162193 | 0.74 |
| MPHOSPH6 | 2865 | 1862820 | C | RECESSIVE | 0.0253166 | 0.75 |
| MPHOSPH6 | 2866 | 2911391 | G | RECESSIVE | 0.0218882 | 0.74 |
| MPHOSPH6 | 2867 | 2967337 | C | RECESSIVE | 0.0392984 | 0.53 |
| CDH13 | 2868 | 12325628 | G | ADDITIVE | 0.0393312 | 0.88 |
| CDH13 | 2870 | 9940179 | A | DOMINANT | 0.0396491 | 1.20 |
| KIAA0182 | 2875 | 3815794 | T | RECESSIVE | 0.0145556 | 1.37 |
| KIAA0182 | 2876 | 736845 | T | ADDITIVE | 0.0008466 | 0.80 |
| KIAA0182 | 2877 | 9940601 | A | ADDITIVE | 0.0081450 | 0.87 |
| KIAA0182 | 2878 | 1049868 | C | RECESSIVE | 0.0003614 | 0.54 |
| KIAA0182 | 2879 | 1053328 | A | RECESSIVE | 0.0030174 | 1.50 |
| GAS7 | 2880 | 1558226 | G | DOMINANT | 0.0349526 | 0.82 |
| DNAH9 | 2882 | 2286305 | T | DOMINANT | 0.0191343 | 0.80 |
| RAB11FIP4 | 2884 | 9901334 | T | ADDITIVE | 0.0147545 | 0.85 |
| CA10 | 2887 | 11655715 | T | RECESSIVE | 0.0182340 | 0.44 |
| MSI2 | 2893 | 1477065 | G | RECESSIVE | 0.0245468 | 0.72 |
| MSI2 | 2894 | 4608395 | C | RECESSIVE | 0.0461877 | 0.65 |
| DNAH17 | 2897 | 7211232 | T | RECESSIVE | 0.0028899 | 0.15 |
| HRNBP3 | 2900 | 4313838 | C | RECESSIVE | 0.0180130 | 0.75 |
| HRNBP3 | 2901 | 4313839 | C | RECESSIVE | 0.0259572 | 0.76 |
| PTPRM | 2911 | 1470323 | T | RECESSIVE | 0.0136419 | 0.73 |
| PTPRM | 2912 | 11081352 | T | RECESSIVE | 0.0027436 | 0.65 |
| PTPRM | 2913 | 2156236 | T | RECESSIVE | 0.0077796 | 0.70 |
| PTPRM | 2914 | 5000485 | T | RECESSIVE | 0.0039162 | 0.68 |
| PTPRM | 2915 | 1942958 | T | RECESSIVE | 0.0065194 | 0.69 |
| PTPRM | 2916 | 8088354 | A | RECESSIVE | 0.0033035 | 0.67 |
| PTPRM | 2917 | 649598 | T | RECESSIVE | 0.0079161 | 0.70 |
| PTPRM | 2918 | 623258 | T | RECESSIVE | 0.0056093 | 0.70 |
| PTPRM | 2920 | 619379 | C | RECESSIVE | 0.0126593 | 0.72 |
| PTPRM | 2921 | 502843 | T | RECESSIVE | 0.0253166 | 0.75 |
| PTPRM | 2922 | 552448 | T | RECESSIVE | 0.0089282 | 0.70 |
| PTPRM | 2923 | 507445 | T | RECESSIVE | 0.0183559 | 0.74 |
| OSBPL1A | 2929 | 6508259 | A | ADDITIVE | 0.0014763 | 1.24 |
| CHST9 | 2932 | 4800787 | T | DOMINANT | 0.0105520 | 1.25 |
| CHST9 | 2933 | 2162412 | A | ADDITIVE | 0.0084702 | 1.15 |
| CHST9 | 2934 | 9949654 | C | ADDITIVE | 0.0105674 | 1.15 |
| CHST9 | 2935 | 9965371 | C | ADDITIVE | 0.0141501 | 1.23 |
| CHST9 | 2936 | 1426879 | G | ADDITIVE | 0.0351731 | 1.13 |
| CHST9 | 2937 | 4800797 | G | ADDITIVE | 0.0091123 | 1.16 |
| CHST9 | 2938 | 9948409 | A | ADDITIVE | 0.0303283 | 1.10 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| KIAA0427 | 2942 | 8095607 | A | ADDITIVE | 0.0332070 | 1.27 |
| KIAA0427 | 2949 | 1319945 | G | RECESSIVE | 0.0326970 | 0.42 |
| DCC | 2951 | 17383821 | G | RECESSIVE | 0.0163221 | 1.42 |
| DCC | 2954 | 9964026 | G | ADDITIVE | 0.0398037 | 1.16 |
| DCC | 2959 | 8084200 | A | DOMINANT | 0.0412987 | 0.83 |
| DCC | 2964 | 9953546 | G | RECESSIVE | 0.0483463 | 2.57 |
| DCC | 2965 | 1394466 | A | RECESSIVE | 0.0256019 | 1.26 |
| DCC | 2966 | 17504520 | G | RECESSIVE | 0.0280368 | 1.26 |
| DCC | 2967 | 11876282 | G | RECESSIVE | 0.0321682 | 1.25 |
| DCC | 2968 | 11876941 | G | RECESSIVE | 0.0392771 | 1.24 |
| DCC | 2969 | 2270954 | A | RECESSIVE | 0.0357727 | 1.94 |
| NEDD4L | 2970 | 7243469 | G | DOMINANT | 0.0412457 | 0.77 |
| NEDD4L | 2971 | 4941312 | T | DOMINANT | 0.0404941 | 0.77 |
| NEDD4L | 2972 | 17064338 | C | DOMINANT | 0.0289103 | 0.76 |
| CCBE1 | 2974 | 895005 | T | DOMINANT | 0.0369089 | 1.20 |
| TXNDC10 | 2975 | 507533 | C | ADDITIVE | 0.0460221 | 1.21 |
| TXNDC10 | 2976 | 12605752 | A | RECESSIVE | 0.0283574 | 0.27 |
| TXNDC10 | 2977 | 7227089 | T | RECESSIVE | 0.0284949 | 0.27 |
| TXNDC10 | 2978 | 1477992 | G | RECESSIVE | 0.0331144 | 0.14 |
| TXNDC10 | 2979 | 309228 | A | RECESSIVE | 0.0279392 | 0.34 |
| TXNDC10 | 2980 | 309251 | C | RECESSIVE | 0.0406452 | 0.36 |
| TXNDC10 | 2981 | 309242 | G | RECESSIVE | 0.0087933 | 0.29 |
| TXNDC10 | 2982 | 590974 | T | DOMINANT | 0.0480823 | 1.19 |
| DOK6 | 2983 | 9947842 | C | RECESSIVE | 0.0143136 | 0.51 |
| DOK6 | 2995 | 4438406 | C | DOMINANT | 0.0044738 | 1.30 |
| LDLR | 3001 | 2738456 | C | RECESSIVE | 0.0433496 | 0.75 |
| RNF24 | 3005 | 241611 | T | DOMINANT | 0.0004744 | 0.74 |
| RNF24 | 3006 | 241612 | A | DOMINANT | 0.0009164 | 0.75 |
| RNF24 | 3007 | 6084530 | C | DOMINANT | 0.0163967 | 0.81 |
| PRNT | 3009 | 2245220 | T | RECESSIVE | 0.0374102 | 0.81 |
| PRNT | 3010 | 2756262 | A | ADDITIVE | 0.0170211 | 0.91 |
| PRNT | 3011 | 2422932 | A | DOMINANT | 0.0057154 | 1.27 |
| PRNT | 3012 | 6084858 | C | RECESSIVE | 0.0489977 | 0.80 |
| PRNT | 3013 | 730999 | T | RECESSIVE | 0.0394947 | 0.79 |
| PLCB1 | 3021 | 6055577 | A | RECESSIVE | 0.0167900 | 1.77 |
| PLCB1 | 3022 | 2235212 | A | RECESSIVE | 0.0331976 | 1.49 |
| PLCB1 | 3023 | 6055601 | A | RECESSIVE | 0.0212322 | 1.65 |
| PLCB1 | 3024 | 13044527 | A | RECESSIVE | 0.0432858 | 1.36 |
| PLCB1 | 3025 | 6039117 | T | RECESSIVE | 0.0489716 | 1.35 |
| PLCB4 | 3028 | 6056454 | G | ADDITIVE | 0.0159695 | 0.86 |
| PLCB4 | 3029 | 4816126 | A | ADDITIVE | 0.0314437 | 0.84 |
| PLCB4 | 3030 | 2145266 | C | ADDITIVE | 0.0193561 | 0.85 |
| PLCB4 | 3031 | 2208295 | C | ADDITIVE | 0.0116134 | 0.83 |
| PLCB4 | 3032 | 6086808 | T | DOMINANT | 0.0355663 | 0.82 |
| JAG1 | 3036 | 3790158 | A | RECESSIVE | 0.0152506 | >5 |
| JAG1 | 3037 | 3748477 | T | RECESSIVE | 0.0152506 | >5 |
| JAG1 | 3038 | 3748478 | T | RECESSIVE | 0.0152506 | >5 |
| MACROD2 | 3040 | 459322 | C | ADDITIVE | 0.0377449 | 0.92 |
| MACROD2 | 3042 | 4814383 | G | RECESSIVE | 0.0026275 | 0.51 |
| MACROD2 | 3044 | 1233763 | C | RECESSIVE | 0.0153543 | 0.61 |
| MACROD2 | 3045 | 1233769 | G | RECESSIVE | 0.0336831 | 0.63 |
| MACROD2 | 3047 | 175810 | G | RECESSIVE | 0.0239964 | 0.57 |
| MACROD2 | 3048 | 175805 | T | RECESSIVE | 0.0464941 | 0.62 |
| PTPRT | 3052 | 6016664 | G | DOMINANT | 0.0474778 | 1.19 |
| PTPRT | 3053 | 6029979 | T | DOMINANT | 0.0496507 | 1.19 |
| PTPRT | 3054 | 6016798 | C | RECESSIVE | 0.0216889 | 0.77 |
| PTPRT | 3055 | 2076082 | A | RECESSIVE | 0.0254923 | 0.77 |
| PTPRT | 3056 | 6065482 | C | RECESSIVE | 0.0271959 | 0.78 |
| PTPRT | 3057 | 6030395 | T | RECESSIVE | 0.0330898 | 1.43 |
| PTGIS | 3064 | 12625166 | T | RECESSIVE | 0.0300284 | >5 |
| BMP7 | 3066 | 162313 | A | RECESSIVE | 0.0457414 | 2.24 |
| BMP7 | 3068 | 1015985 | A | RECESSIVE | 0.0457414 | 2.24 |
| GNAS | 3071 | 7121 | T | DOMINANT | 0.0144299 | 1.27 |
| CDH4 | 3073 | 1891490 | A | ADDITIVE | 0.0135434 | 1.13 |
| CDH4 | 3074 | 3752252 | G | DOMINANT | 0.0086970 | 1.26 |
| CDH4 | 3075 | 1970546 | A | ADDITIVE | 0.0035930 | 1.21 |
| CDH4 | 3086 | 6061845 | G | ADDITIVE | 0.0156651 | 0.88 |
| CDH4 | 3087 | 1891572 | T | DOMINANT | 0.0372843 | 0.83 |
| CDH4 | 3088 | 17811544 | G | DOMINANT | 0.0279199 | 0.82 |
| CDH4 | 3089 | 6142875 | T | DOMINANT | 0.0249437 | 0.82 |
| NCAM2 | 3090 | 2226806 | C | RECESSIVE | 0.0022837 | 1.42 |
| NCAM2 | 3091 | 2826349 | G | RECESSIVE | 0.0183510 | 1.44 |
| NCAM2 | 3092 | 2826351 | A | RECESSIVE | 0.0203522 | 1.43 |
| NCAM2 | 3094 | 11702660 | A | RECESSIVE | 0.0344979 | 7.10 |
| NCAM2 | 3095 | 232490 | C | DOMINANT | 0.0133412 | 0.81 |

TABLE 1-continued

Alleles and Genotypes Influencing Likelihood of Bipolar vs. Schizophrenia Diagnoses

| Gene | SEQ ID NO: | NCBI RS# | Allele | Model | P | Odds Ratio |
|---|---|---|---|---|---|---|
| NCAM2 | 3096 | 232491 | T | DOMINANT | 0.0081579 | 0.79 |
| NCAM2 | 3097 | 2826815 | T | DOMINANT | 0.0017598 | 0.76 |
| NCAM2 | 3098 | 232509 | T | ADDITIVE | 0.0078224 | 0.81 |
| NCAM2 | 3099 | 232516 | A | DOMINANT | 0.0163957 | 0.81 |
| NCAM2 | 3100 | 2826818 | G | DOMINANT | 0.0015795 | 0.76 |
| NCAM2 | 3101 | 232424 | T | DOMINANT | 0.0064791 | 0.79 |
| NCAM2 | 3102 | 2826826 | A | DOMINANT | 0.0026054 | 0.77 |
| NCAM2 | 3103 | 232446 | G | DOMINANT | 0.0060568 | 0.79 |
| NCAM2 | 3104 | 2847461 | T | DOMINANT | 0.0017547 | 0.76 |
| NCAM2 | 3105 | 2826830 | G | ADDITIVE | 0.0115585 | 0.81 |
| NCAM2 | 3106 | 3787603 | G | ADDITIVE | 0.0111789 | 0.82 |
| SLC37A1 | 3113 | 12483006 | A | RECESSIVE | 0.0195839 | 1.73 |
| SLC37A1 | 3116 | 1788421 | G | DOMINANT | 0.0073634 | 0.79 |
| PDE9A | 3117 | 2269139 | T | RECESSIVE | 0.0363891 | 1.93 |
| PDE9A | 3118 | 2269143 | A | RECESSIVE | 0.0319822 | 2.04 |
| PDE9A | 3119 | 2269173 | G | ADDITIVE | 0.0048662 | 0.89 |
| ASPHD2 | 3121 | 11913750 | C | DOMINANT | 0.0310367 | 0.73 |
| ASPHD2 | 3122 | 16982107 | T | DOMINANT | 0.0360544 | 0.74 |
| TTLL1 | 3124 | 5996268 | C | ADDITIVE | 0.0470533 | 0.78 |
| EFCAB6 | 3125 | 137746 | C | RECESSIVE | 0.0364594 | 1.93 |
| EFCAB6 | 3126 | 137767 | T | RECESSIVE | 0.0254356 | 2.01 |
| EFCAB6 | 3127 | 137801 | A | RECESSIVE | 0.0333977 | 2.26 |
| EFCAB6 | 3128 | 1013039 | C | RECESSIVE | 0.0494874 | 1.87 |
| EFCAB6 | 3129 | 5764302 | G | RECESSIVE | 0.0254356 | 2.01 |
| SULT4A1 | 3130 | 5764318 | C | RECESSIVE | 0.0175703 | 0.50 |
| SULT4A1 | 3131 | 2066915 | C | ADDITIVE | 0.0262448 | 1.13 |
| SULT4A1 | 3133 | 2285162 | A | RECESSIVE | 0.0311834 | 0.69 |
| SULT4A1 | 3134 | 2285166 | T | RECESSIVE | 0.0307734 | 0.68 |
| SULT4A1 | 3135 | 2285167 | A | RECESSIVE | 0.0080914 | 0.46 |
| SULT4A1 | 3137 | 5764367 | T | RECESSIVE | 0.0352891 | 0.69 |
| RIBC2 | 3138 | 5765397 | A | RECESSIVE | 0.0330656 | 1.26 |
| RIBC2 | 3139 | 2092101 | G | RECESSIVE | 0.0292451 | 1.27 |
| RIBC2 | 3140 | 5764751 | C | RECESSIVE | 0.0338442 | 1.24 |
| RIBC2 | 3141 | 5765425 | A | RECESSIVE | 0.0188752 | 1.30 |

Example 2

Genotypes and Alleles that Contribute to Risk of BD or SZ

The same methods described above in Example 1 to identify SNPs that were differentially associated with BD or SZ. Specifically, this analysis examined alleles that contributed to a diagnosis of either BD or SZ. For example, a given SNP could enhance likelihood of diagnosis of both BD and SZ. Those SNPs that contribute to the likelihood of diagnosis of both diseases may be those SNPs that contribute the overlapping symptom pattern between BD and SZ, e.g. SNPs that contribute to mania, depression, or delusions.

Table 2 lists alleles and genotypes influencing a diagnosis of, or risk of developing, BD or SZ. 640 BD cases, and a randomly selected subset of 640 SZ cases, and 1378 neurologically normal controls were used to identify these alleles and genotypes. Briefly, BD cases and SZ cases were both considered cases and were coded as a 1 (or case) and each control was coded as 0. Combining BD and SZ in this manner identifies those SNPs that contribute to a diagnosis of, or risk of developing, broadly defined serious psychiatric illness (psychosis). Using this coding and genotypes provided by GAIN, case control analysis was performed using various genetic models (recessive, dominant and additive) in Golden Helix's SNP and Variation Suite v 7.0 (SVS™). Table 2 lists the gene, SEQ ID NO:, NCBI RS number, test allele, genetic model, odds ratio, and p-value for the comparison. In this example, an OR greater than 1 indicates that the subject has a greater likelihood of a BD or SZ diagnosis. Similarly, an OR less than 1 indicates that the subject has a lower likelihood of a BD or SZ diagnosis.

TABLE 2

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| RP1-21O18.1 | 5 | 1000313 | G | ADDITIVE | 0.023031 | 1.13 |
| RP1-21O18.1 | 6 | 4501834 | C | ADDITIVE | 0.010524 | 1.14 |
| RP1-21O18.1 | 7 | 10803349 | A | ADDITIVE | 0.007056 | 1.15 |
| RP1-21O18.1 | 8 | 4661575 | T | RECESSIVE | 0.002888 | 1.45 |
| AGBL4-C1ORF165 | 13 | 11205538 | C | DOMINANT | 0.003952 | 1.23 |
| AGBL4-C1ORF165 | 14 | 7520784 | A | DOMINANT | 0.005937 | 1.21 |
| AGBL4-C1ORF165 | 15 | 10888622 | G | DOMINANT | 0.010006 | 1.20 |
| AGBL4-C1ORF165 | 16 | 4926759 | C | DOMINANT | 0.015223 | 1.19 |
| AGBL4-C1ORF165 | 17 | 1934368 | C | DOMINANT | 0.020949 | 1.18 |
| AGBL4-C1ORF165 | 19 | 3122291 | T | DOMINANT | 0.001607 | 1.25 |
| AGBL4-C1ORF165 | 20 | 3121512 | C | DOMINANT | 0.001749 | 1.27 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| AGBL4-C1ORF165 | 21 | 3118215 | A | ADDITIVE | 0.004611 | 1.23 |
| AGBL4-C1ORF165 | 22 | 3118223 | G | ADDITIVE | 0.003490 | 1.23 |
| AGBL4-C1ORF165 | 23 | 3121273 | G | ADDITIVE | 0.001892 | 1.23 |
| AGBL4-C1ORF165 | 24 | 3127556 | G | ADDITIVE | 0.003664 | 1.22 |
| AGBL4-C1ORF165 | 25 | 3121518 | A | ADDITIVE | 0.003788 | 1.21 |
| AGBL4-C1ORF165 | 26 | 6669433 | A | ADDITIVE | 0.004697 | 1.23 |
| AGBL4-C1ORF165 | 27 | 7520773 | T | RECESSIVE | 0.004313 | 1.38 |
| LRP8 | 28 | 17785382 | G | RECESSIVE | 0.000489 | 0.71 |
| LRP8 | 29 | 5177 | C | ADDITIVE | 0.002955 | 0.89 |
| LRP8 | 30 | 11206127 | A | DOMINANT | 0.001922 | 0.79 |
| LRP8 | 31 | 869987 | T | DOMINANT | 0.001601 | 0.79 |
| LRP8 | 32 | 869988 | C | DOMINANT | 0.001625 | 0.79 |
| LRP8 | 33 | 2297660 | A | ADDITIVE | 0.003823 | 0.89 |
| LRP8 | 34 | 2297657 | A | RECESSIVE | 0.004002 | 0.75 |
| LRP8 | 35 | 4623641 | T | RECESSIVE | 0.022652 | 0.79 |
| PRKACB | 39 | 589373 | A | ADDITIVE | 0.045631 | 1.15 |
| SLC6A17 | 40 | 17671169 | A | ADDITIVE | 0.044442 | 1.11 |
| SLC6A17 | 41 | 495959 | T | ADDITIVE | 0.015930 | 0.82 |
| SLC16A4 | 43 | 4498805 | G | ADDITIVE | 0.026757 | 0.83 |
| SLC16A4 | 44 | 2271885 | C | ADDITIVE | 0.047401 | 1.32 |
| SYT6 | 46 | 611514 | A | RECESSIVE | 0.011843 | 0.80 |
| NGF | 47 | 7523654 | T | ADDITIVE | 0.000414 | 1.31 |
| NGF | 48 | 11102924 | G | DOMINANT | 0.001940 | 1.27 |
| NGF | 49 | 10776799 | G | DOMINANT | 0.000102 | 1.34 |
| NGF | 50 | 4332358 | T | DOMINANT | 0.000031 | 1.34 |
| NGF | 51 | 17033706 | A | DOMINANT | 0.000303 | 1.33 |
| SLC22A15 | 53 | 2488432 | T | DOMINANT | 0.043650 | 0.87 |
| PTGFRN | 56 | 12090536 | G | RECESSIVE | 0.009209 | 0.71 |
| PTGFRN | 57 | 7552382 | G | RECESSIVE | 0.012344 | 0.73 |
| PTGFRN | 58 | 3829881 | A | DOMINANT | 0.007166 | 1.24 |
| CGN | 60 | 10788807 | G | DOMINANT | 0.049612 | 0.85 |
| ATF6 | 63 | 905594 | T | ADDITIVE | 0.009476 | 0.83 |
| ATF6 | 66 | 1875762 | T | ADDITIVE | 0.001909 | 0.80 |
| ATF6 | 68 | 10918029 | A | ADDITIVE | 0.000629 | 0.71 |
| ATF6 | 79 | 2499854 | G | ADDITIVE | 0.045617 | 0.88 |
| OLFML2B | 80 | 4657130 | G | RECESSIVE | 0.001979 | 0.72 |
| OLFML2B | 81 | 4657131 | A | RECESSIVE | 0.001212 | 0.70 |
| OLFML2B | 82 | 2490420 | G | RECESSIVE | 0.002385 | 0.71 |
| OLFML2B | 83 | 4657132 | G | RECESSIVE | 0.000790 | 0.71 |
| OLFML2B | 84 | 6691548 | C | RECESSIVE | 0.000739 | 0.70 |
| CACNA1E | 92 | 553042 | C | DOMINANT | 0.005496 | 1.22 |
| CACNA1E | 93 | 486708 | T | DOMINANT | 0.009729 | 1.20 |
| CACNA1E | 94 | 17441683 | A | ADDITIVE | 0.015582 | 1.21 |
| CACNA1E | 95 | 17494681 | T | ADDITIVE | 0.014240 | 1.23 |
| LAMC1 | 103 | 6658501 | A | DOMINANT | 0.000552 | 0.76 |
| LAMC1 | 104 | 4652772 | G | DOMINANT | 0.001674 | 0.78 |
| LAMC1 | 105 | 3935384 | G | DOMINANT | 0.000298 | 0.75 |
| LAMC1 | 106 | 10797829 | A | DOMINANT | 0.000298 | 0.75 |
| LAMC1 | 107 | 10911232 | T | RECESSIVE | 0.003177 | 1.32 |
| LAMC1 | 108 | 12091137 | A | DOMINANT | 0.000146 | 0.75 |
| LAMC1 | 109 | 12086466 | T | DOMINANT | 0.000103 | 0.74 |
| LAMC1 | 110 | 10797838 | A | DOMINANT | 0.000079 | 0.74 |
| LAMC1 | 111 | 10797839 | T | DOMINANT | 0.000065 | 0.74 |
| LAMC1 | 112 | 10752898 | T | DOMINANT | 0.000043 | 0.73 |
| LAMC1 | 113 | 10797842 | G | DOMINANT | 0.000062 | 0.73 |
| LAMC1 | 114 | 6424888 | A | DOMINANT | 0.000122 | 0.74 |
| LAMC1 | 115 | 20563 | A | DOMINANT | 0.000133 | 0.75 |
| LAMC1 | 116 | 3768617 | A | RECESSIVE | 0.002595 | 1.32 |
| LAMC1 | 117 | 7518957 | A | DOMINANT | 0.000063 | 0.74 |
| LAMC1 | 118 | 1360704 | G | RECESSIVE | 0.001865 | 1.33 |
| LAMC1 | 119 | 2274984 | C | DOMINANT | 0.000253 | 0.75 |
| LAMC1 | 120 | 2027085 | A | DOMINANT | 0.000180 | 0.75 |
| KCNH1 | 123 | 1340127 | C | DOMINANT | 0.017478 | 0.83 |
| KCNH1 | 129 | 7537388 | C | RECESSIVE | 0.041062 | 1.56 |
| KCNK2 | 132 | 4655272 | A | DOMINANT | 0.006028 | 1.24 |
| KCNK2 | 133 | 10494994 | A | DOMINANT | 0.013011 | 1.20 |
| KCNK2 | 134 | 12038695 | C | DOMINANT | 0.008288 | 1.22 |
| KCNK2 | 135 | 11120519 | A | ADDITIVE | 0.002214 | 1.28 |
| KCNK2 | 137 | 11120527 | T | DOMINANT | 0.003193 | 1.24 |
| USH2A | 138 | 11120538 | A | DOMINANT | 0.005019 | 1.23 |
| USH2A | 139 | 6674743 | T | DOMINANT | 0.006689 | 1.22 |
| USH2A | 140 | 2677117 | A | DOMINANT | 0.024546 | 1.17 |
| USH2A | 141 | 2677111 | C | DOMINANT | 0.009890 | 1.20 |
| ESRRG | 143 | 12027901 | C | DOMINANT | 0.019424 | 1.23 |
| ESRRG | 144 | 7529655 | A | RECESSIVE | 0.019137 | 0.60 |
| RYR2 | 156 | 16835170 | C | RECESSIVE | 0.021686 | 1.31 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| RYR2 | 157 | 2779397 | C | DOMINANT | 0.017430 | 0.84 |
| RYR2 | 158 | 2779400 | A | DOMINANT | 0.022488 | 0.85 |
| FMN2 | 162 | 12122068 | C | ADDITIVE | 0.005347 | 0.80 |
| FMN2 | 163 | 10926223 | C | ADDITIVE | 0.010874 | 0.80 |
| FMN2 | 164 | 12130718 | A | ADDITIVE | 0.011256 | 0.86 |
| KCNF1 | 192 | 2884310 | G | ADDITIVE | 0.045453 | 1.11 |
| NAG | 193 | 3805093 | C | ADDITIVE | 0.048493 | 0.87 |
| NAG | 194 | 10206116 | C | ADDITIVE | 0.032081 | 0.86 |
| HS1BP3 | 195 | 3732157 | A | ADDITIVE | 0.012752 | 1.19 |
| HS1BP3 | 196 | 1047176 | T | DOMINANT | 0.005932 | 1.22 |
| HS1BP3 | 197 | 7586298 | T | ADDITIVE | 0.027521 | 1.18 |
| ASXL2 | 210 | 6747116 | C | DOMINANT | 0.009733 | 1.22 |
| CIB4 | 213 | 11694917 | T | ADDITIVE | 0.034547 | 0.79 |
| DPYSL5 | 215 | 12991828 | G | DOMINANT | 0.039784 | 0.86 |
| DPYSL5 | 216 | 6756245 | C | DOMINANT | 0.047309 | 0.86 |
| BRE | 217 | 6706209 | C | DOMINANT | 0.018802 | 0.84 |
| BRE | 221 | 6738887 | C | DOMINANT | 0.044436 | 0.87 |
| CRIM1 | 224 | 2160367 | C | RECESSIVE | 0.024909 | 1.22 |
| CRIM1 | 225 | 711252 | T | DOMINANT | 0.016634 | 0.83 |
| CRIM1 | 226 | 848556 | T | DOMINANT | 0.000503 | 0.76 |
| CRIM1 | 227 | 848553 | C | DOMINANT | 0.022784 | 0.83 |
| CRIM1 | 228 | 848552 | G | DOMINANT | 0.011423 | 0.82 |
| CRIM1 | 229 | 848547 | G | DOMINANT | 0.015172 | 0.82 |
| CRIM1 | 230 | 3770852 | A | DOMINANT | 0.001510 | 0.80 |
| CRIM1 | 233 | 3770833 | A | DOMINANT | 0.003501 | 0.81 |
| CRIM1 | 234 | 2293254 | G | DOMINANT | 0.011868 | 0.83 |
| CRIM1 | 235 | 2287082 | T | DOMINANT | 0.001615 | 0.80 |
| CRIM1 | 236 | 3755197 | A | DOMINANT | 0.003015 | 0.81 |
| CRIM1 | 237 | 11681392 | T | DOMINANT | 0.000473 | 0.78 |
| FEZ2 | 238 | 10189344 | C | DOMINANT | 0.001795 | 0.80 |
| FEZ2 | 239 | 10172196 | A | DOMINANT | 0.000792 | 0.79 |
| FEZ2 | 240 | 3770811 | T | DOMINANT | 0.000125 | 0.76 |
| FEZ2 | 241 | 1533949 | T | DOMINANT | 0.001063 | 0.79 |
| FEZ2 | 242 | 1533948 | C | DOMINANT | 0.000233 | 0.77 |
| FEZ2 | 243 | 1533946 | G | DOMINANT | 0.000165 | 0.76 |
| FEZ2 | 244 | 13406184 | C | DOMINANT | 0.000122 | 0.76 |
| FEZ2 | 245 | 17488036 | G | DOMINANT | 0.000220 | 0.77 |
| FEZ2 | 246 | 2022211 | G | DOMINANT | 0.000419 | 0.77 |
| FEZ2 | 247 | 10197570 | T | DOMINANT | 0.001223 | 0.79 |
| FEZ2 | 248 | 11691767 | T | DOMINANT | 0.000737 | 0.79 |
| FEZ2 | 249 | 10469898 | G | DOMINANT | 0.001462 | 0.80 |
| FEZ2 | 250 | 5003670 | C | DOMINANT | 0.006521 | 0.82 |
| CDC42EP3 | 252 | 15628 | T | ADDITIVE | 0.032228 | 1.21 |
| SLC8A1 | 253 | 6544318 | A | ADDITIVE | 0.017655 | 0.81 |
| SLC8A1 | 254 | 759384 | C | ADDITIVE | 0.023659 | 0.84 |
| SLC8A1 | 255 | 4952609 | G | ADDITIVE | 0.023271 | 0.87 |
| HAAO | 256 | 13398984 | T | RECESSIVE | 0.049160 | 0.72 |
| HAAO | 257 | 4564826 | A | ADDITIVE | 0.003779 | 0.88 |
| C2ORF34 | 261 | 786613 | G | DOMINANT | 0.000401 | 1.28 |
| C2ORF34 | 262 | 786616 | G | DOMINANT | 0.008815 | 1.20 |
| C2ORF34 | 263 | 786626 | C | DOMINANT | 0.000284 | 1.29 |
| C2ORF34 | 264 | 786624 | T | DOMINANT | 0.000304 | 1.29 |
| C2ORF34 | 265 | 1067343 | A | DOMINANT | 0.007403 | 1.21 |
| C2ORF34 | 266 | 1067386 | G | DOMINANT | 0.000931 | 1.26 |
| C2ORF34 | 267 | 1067383 | G | DOMINANT | 0.006617 | 1.21 |
| C2ORF34 | 268 | 1584885 | C | ADDITIVE | 0.000081 | 1.32 |
| C2ORF34 | 269 | 1067378 | A | DOMINANT | 0.008498 | 1.21 |
| C2ORF34 | 270 | 1067375 | C | DOMINANT | 0.009726 | 1.20 |
| C2ORF34 | 271 | 1067374 | G | DOMINANT | 0.007631 | 1.21 |
| C2ORF34 | 272 | 1067367 | A | DOMINANT | 0.001689 | 1.25 |
| C2ORF34 | 273 | 1065786 | T | DOMINANT | 0.000625 | 1.27 |
| C2ORF34 | 274 | 1067355 | C | DOMINANT | 0.010313 | 1.20 |
| C2ORF34 | 275 | 1085447 | T | DOMINANT | 0.000515 | 1.28 |
| C2ORF34 | 276 | 1067348 | T | DOMINANT | 0.007260 | 1.21 |
| C2ORF34 | 277 | 1067347 | C | DOMINANT | 0.000360 | 1.29 |
| C2ORF34 | 278 | 1067406 | C | DOMINANT | 0.000404 | 1.29 |
| C2ORF34 | 279 | 1067404 | A | DOMINANT | 0.002957 | 1.24 |
| C2ORF34 | 280 | 1067402 | T | DOMINANT | 0.005635 | 1.22 |
| C2ORF34 | 281 | 1067397 | A | DOMINANT | 0.012315 | 1.20 |
| C2ORF34 | 282 | 698792 | A | DOMINANT | 0.010748 | 1.20 |
| C2ORF34 | 283 | 786419 | G | DOMINANT | 0.000789 | 1.27 |
| C2ORF34 | 284 | 698793 | C | DOMINANT | 0.007146 | 1.21 |
| C2ORF34 | 285 | 2166453 | G | ADDITIVE | 0.000143 | 1.28 |
| C2ORF34 | 286 | 698809 | A | DOMINANT | 0.015551 | 1.19 |
| C2ORF34 | 287 | 698823 | G | DOMINANT | 0.001215 | 1.26 |
| C2ORF34 | 288 | 698824 | C | DOMINANT | 0.000552 | 1.28 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| C2ORF34 | 289 | 698827 | G | DOMINANT | 0.003581 | 1.23 |
| C2ORF34 | 290 | 698828 | T | DOMINANT | 0.006854 | 1.21 |
| C2ORF34 | 291 | 698832 | C | DOMINANT | 0.004858 | 1.22 |
| C2ORF34 | 292 | 698833 | T | DOMINANT | 0.004272 | 1.22 |
| C2ORF34 | 293 | 786406 | T | DOMINANT | 0.003550 | 1.23 |
| C2ORF34 | 294 | 11888605 | A | DOMINANT | 0.010202 | 1.21 |
| C2ORF34 | 295 | 3862996 | G | DOMINANT | 0.000228 | 1.31 |
| C2ORF34 | 296 | 1011798 | C | ADDITIVE | 0.003870 | 1.22 |
| C2ORF34 | 297 | 729310 | A | DOMINANT | 0.003360 | 1.24 |
| C2ORF34 | 298 | 2341457 | A | DOMINANT | 0.006713 | 1.22 |
| C2ORF34 | 299 | 1377906 | G | DOMINANT | 0.045305 | 1.15 |
| C2ORF34 | 300 | 7609431 | C | DOMINANT | 0.045594 | 1.15 |
| C2ORF34 | 301 | 4953101 | T | DOMINANT | 0.009825 | 1.20 |
| C2ORF34 | 303 | 13383854 | G | DOMINANT | 0.003965 | 1.24 |
| C2ORF34 | 304 | 6721746 | A | RECESSIVE | 0.002125 | 0.52 |
| C2ORF34 | 305 | 7603180 | G | RECESSIVE | 0.019588 | 0.61 |
| C2ORF34 | 306 | 11679997 | T | RECESSIVE | 0.005864 | 0.56 |
| PRKCE | 307 | 2881068 | C | ADDITIVE | 0.031005 | 0.88 |
| PRKCE | 308 | 4952792 | C | RECESSIVE | 0.012801 | 0.77 |
| PRKCE | 310 | 12989656 | T | DOMINANT | 0.029417 | 1.17 |
| EPAS1 | 311 | 1374749 | A | DOMINANT | 0.002654 | 0.79 |
| EPAS1 | 312 | 10178633 | A | DOMINANT | 0.009113 | 0.81 |
| EPAS1 | 313 | 13006131 | G | RECESSIVE | 0.041003 | 1.18 |
| AAK1 | 321 | 2312207 | T | DOMINANT | 0.013618 | 0.82 |
| CTNNA2 | 327 | 2566539 | T | ADDITIVE | 0.032627 | 0.89 |
| CTNNA2 | 332 | 7577376 | G | RECESSIVE | 0.042889 | 1.83 |
| CTNNA2 | 333 | 17018760 | T | RECESSIVE | 0.027435 | 1.95 |
| CTNNA2 | 334 | 1443897 | C | RECESSIVE | 0.047455 | 1.84 |
| CTNNA2 | 335 | 7576232 | T | RECESSIVE | 0.036371 | 1.90 |
| CTNNA2 | 336 | 7570531 | C | RECESSIVE | 0.030140 | 1.97 |
| CTNNA2 | 337 | 961408 | G | RECESSIVE | 0.047146 | 1.84 |
| CTNNA2 | 338 | 1446107 | G | RECESSIVE | 0.019905 | 2.17 |
| CTNNA2 | 339 | 1446108 | A | RECESSIVE | 0.019950 | 2.17 |
| CTNNA2 | 341 | 1965834 | T | ADDITIVE | 0.037994 | 1.13 |
| CTNNA2 | 342 | 1965833 | G | RECESSIVE | 0.031176 | 1.74 |
| CTNNA2 | 343 | 2165975 | T | RECESSIVE | 0.039586 | 1.91 |
| CTNNA2 | 344 | 6738092 | C | RECESSIVE | 0.039410 | 1.92 |
| INPP4A | 345 | 17446058 | G | DOMINANT | 0.020841 | 1.18 |
| NAP5 | 346 | 12478698 | C | ADDITIVE | 0.046440 | 0.85 |
| NAP5 | 347 | 10174856 | C | ADDITIVE | 0.035515 | 1.08 |
| NAP5 | 348 | 1437904 | T | ADDITIVE | 0.047914 | 1.07 |
| NAP5 | 350 | 13421559 | G | RECESSIVE | 0.020681 | 1.59 |
| RAB3GAP1 | 351 | 10186594 | G | DOMINANT | 0.018167 | 1.21 |
| RAB3GAP1 | 352 | 17293519 | G | DOMINANT | 0.026159 | 1.20 |
| RAB3GAP1 | 353 | 2874739 | T | DOMINANT | 0.022042 | 1.21 |
| RAB3GAP1 | 355 | 3739028 | G | DOMINANT | 0.036625 | 1.58 |
| ZRANB3 | 356 | 1898524 | T | DOMINANT | 0.040695 | 1.48 |
| LRP1B | 357 | 1492388 | T | RECESSIVE | 0.005578 | 1.34 |
| LRP1B | 358 | 12479163 | A | RECESSIVE | 0.007088 | 1.46 |
| LRP1B | 364 | 972485 | A | ADDITIVE | 0.023486 | 1.17 |
| LRP1B | 366 | 1369528 | G | ADDITIVE | 0.020164 | 0.86 |
| LRP1B | 367 | 6429927 | G | DOMINANT | 0.012980 | 1.20 |
| LRP1B | 368 | 13408365 | A | DOMINANT | 0.013165 | 1.20 |
| LRP1B | 369 | 10165154 | C | DOMINANT | 0.015857 | 1.19 |
| LRP1B | 370 | 13418027 | T | DOMINANT | 0.041922 | 1.17 |
| FMNL2 | 395 | 1155779 | C | ADDITIVE | 0.035232 | 0.86 |
| FMNL2 | 396 | 1370504 | G | RECESSIVE | 0.019686 | 1.49 |
| FMNL2 | 397 | 10193104 | A | RECESSIVE | 0.019152 | 1.48 |
| PLA2R1 | 403 | 3828324 | C | RECESSIVE | 0.028752 | 0.83 |
| PLA2R1 | 404 | 3792189 | C | DOMINANT | 0.001395 | 1.26 |
| PLA2R1 | 405 | 4665138 | T | RECESSIVE | 0.006305 | 0.80 |
| PLA2R1 | 406 | 17241282 | C | RECESSIVE | 0.001488 | 0.75 |
| PLA2R1 | 407 | 17830904 | G | RECESSIVE | 0.007897 | 0.80 |
| KCNH7 | 408 | 9287822 | C | RECESSIVE | 0.030714 | 0.57 |
| KCNH7 | 409 | 9807929 | T | RECESSIVE | 0.016298 | 0.54 |
| KCNH7 | 410 | 4091356 | T | RECESSIVE | 0.012100 | 0.54 |
| SCN2A | 412 | 353128 | G | RECESSIVE | 0.004556 | 1.35 |
| SCN1A | 416 | 1824551 | C | RECESSIVE | 0.008412 | 1.34 |
| SCN1A | 418 | 7607543 | C | RECESSIVE | 0.047154 | 1.40 |
| SCN1A | 419 | 1461197 | A | RECESSIVE | 0.006218 | 1.35 |
| SCN1A | 420 | 1824549 | G | RECESSIVE | 0.012012 | 1.32 |
| SCN1A | 421 | 1381105 | G | RECESSIVE | 0.014105 | 1.31 |
| SCN9A | 423 | 6756630 | A | RECESSIVE | 0.024679 | 1.78 |
| SCN9A | 424 | 3924001 | T | ADDITIVE | 0.008161 | 0.94 |
| SCN9A | 425 | 6747673 | T | RECESSIVE | 0.025748 | 0.83 |
| CERKL | 432 | 1967351 | C | RECESSIVE | 0.003041 | 0.74 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| PDE1A | 438 | 16823124 | A | ADDITIVE | 0.001819 | 1.20 |
| PDE1A | 439 | 1430158 | C | ADDITIVE | 0.039304 | 1.18 |
| PDE1A | 440 | 10497597 | T | ADDITIVE | 0.003065 | 1.25 |
| TMEFF2 | 442 | 10497725 | C | RECESSIVE | 0.015237 | 1.31 |
| TMEFF2 | 445 | 4853492 | T | DOMINANT | 0.011412 | 1.20 |
| TMEFF2 | 446 | 10191803 | T | DOMINANT | 0.011724 | 1.20 |
| ALS2 | 447 | 6731583 | C | DOMINANT | 0.034680 | 1.19 |
| ABI2 | 448 | 10197623 | T | RECESSIVE | 0.004368 | 1.53 |
| PARD3B | 453 | 17626122 | C | DOMINANT | 0.008669 | 0.82 |
| PARD3B | 454 | 12469145 | C | DOMINANT | 0.019983 | 0.84 |
| ERBB4 | 460 | 10210330 | T | ADDITIVE | 0.025685 | 1.14 |
| ERBB4 | 461 | 4672668 | G | ADDITIVE | 0.032214 | 1.14 |
| COL4A4 | 482 | 13382950 | C | DOMINANT | 0.015788 | 1.21 |
| DNER | 489 | 6733289 | G | ADDITIVE | 0.031550 | 1.09 |
| SAG | 496 | 2241874 | A | RECESSIVE | 0.006025 | 0.75 |
| SAG | 497 | 2241873 | C | RECESSIVE | 0.008788 | 0.76 |
| CENTG2 | 498 | 2292708 | T | ADDITIVE | 0.027226 | 0.85 |
| CENTG2 | 500 | 10929160 | T | RECESSIVE | 0.028919 | 1.23 |
| CNTN6 | 502 | 3902672 | G | DOMINANT | 0.040582 | 0.85 |
| CNTN6 | 505 | 155390 | G | ADDITIVE | 0.009897 | 0.78 |
| CNTN6 | 507 | 155391 | C | ADDITIVE | 0.007737 | 0.77 |
| CNTN4 | 518 | 2063896 | A | ADDITIVE | 0.036403 | 0.92 |
| CNTN4 | 519 | 12494838 | G | RECESSIVE | 0.014353 | 0.73 |
| CNTN4 | 523 | 163574 | A | ADDITIVE | 0.000838 | 1.36 |
| CNTN4 | 524 | 163352 | G | DOMINANT | 0.029184 | 1.18 |
| ITPR1 | 525 | 304041 | G | ADDITIVE | 0.039812 | 1.06 |
| IRAK2 | 531 | 696041 | A | RECESSIVE | 0.013603 | 1.83 |
| SLC6A1 | 536 | 1062246 | G | RECESSIVE | 0.012815 | 0.76 |
| GADL1 | 538 | 1494730 | C | DOMINANT | 0.040974 | 0.86 |
| FBXL2 | 539 | 9880596 | C | ADDITIVE | 0.029534 | 1.12 |
| CLASP2 | 544 | 7624319 | G | RECESSIVE | 0.018826 | 1.31 |
| CLASP2 | 545 | 7641020 | G | RECESSIVE | 0.033987 | 1.21 |
| ARPP-21 | 546 | 9811585 | G | DOMINANT | 0.010468 | 1.20 |
| ARPP-21 | 547 | 2278758 | A | RECESSIVE | 0.002872 | 0.40 |
| ARPP-21 | 548 | 2012153 | G | RECESSIVE | 0.000352 | 0.74 |
| ARPP-21 | 549 | 7621692 | T | RECESSIVE | 0.016503 | 0.48 |
| ARPP-21 | 550 | 6550367 | C | RECESSIVE | 0.007170 | 0.80 |
| ARPP-21 | 551 | 2305234 | A | RECESSIVE | 0.011295 | 0.47 |
| STAC | 552 | 17186340 | T | RECESSIVE | 0.037390 | 2.57 |
| CAMKV | 564 | 2883059 | C | RECESSIVE | 0.003731 | 0.77 |
| CACNA2D3 | 581 | 1467179 | A | DOMINANT | 0.004411 | 1.24 |
| CACNA2D3 | 582 | 1467178 | T | DOMINANT | 0.002068 | 1.26 |
| CACNA2D3 | 583 | 3773580 | T | DOMINANT | 0.002278 | 1.24 |
| CACNA2D3 | 584 | 17054677 | A | ADDITIVE | 0.006768 | 1.27 |
| CACNA2D3 | 585 | 3773569 | A | DOMINANT | 0.001038 | 1.27 |
| FLNB | 588 | 12488636 | C | RECESSIVE | 0.027938 | 1.29 |
| FLNB | 589 | 7373012 | G | RECESSIVE | 0.006274 | 0.71 |
| FHIT | 590 | 639244 | C | DOMINANT | 0.017999 | 0.84 |
| FHIT | 599 | 2736823 | T | DOMINANT | 0.040257 | 0.86 |
| CADPS | 606 | 1812677 | G | ADDITIVE | 0.019052 | 1.12 |
| CADPS | 607 | 1398623 | G | DOMINANT | 0.004679 | 1.24 |
| CADPS | 608 | 304233 | G | ADDITIVE | 0.014797 | 1.14 |
| CADPS | 609 | 526163 | A | ADDITIVE | 0.023865 | 1.10 |
| CADPS | 610 | 9854059 | T | ADDITIVE | 0.043479 | 1.08 |
| SYNPR | 611 | 6809418 | T | DOMINANT | 0.020076 | 1.19 |
| PRICKLE2 | 614 | 696016 | A | RECESSIVE | 0.004590 | 2.69 |
| PRICKLE2 | 615 | 696017 | A | RECESSIVE | 0.008484 | 2.44 |
| PRICKLE2 | 616 | 704398 | G | RECESSIVE | 0.001129 | 3.04 |
| PRICKLE2 | 617 | 697288 | T | RECESSIVE | 0.001166 | 3.18 |
| MAGI1 | 618 | 2222582 | T | ADDITIVE | 0.024962 | 0.94 |
| MAGI1 | 619 | 9859408 | T | ADDITIVE | 0.014405 | 1.18 |
| MAGI1 | 621 | 264705 | A | ADDITIVE | 0.033436 | 1.16 |
| FAM19A1 | 622 | 17140779 | G | ADDITIVE | 0.025219 | 0.86 |
| FAM19A1 | 623 | 11707519 | G | DOMINANT | 0.013989 | 1.25 |
| ROBO2 | 625 | 9882239 | C | ADDITIVE | 0.004971 | 1.25 |
| ROBO1 | 631 | 4564923 | T | ADDITIVE | 0.027376 | 1.12 |
| EPHA6 | 634 | 4571251 | T | ADDITIVE | 0.039238 | 1.39 |
| PLCXD2 | 640 | 9870533 | A | RECESSIVE | 0.032427 | 0.59 |
| PLCXD2 | 641 | 6807632 | T | ADDITIVE | 0.026521 | 1.43 |
| KALRN | 643 | 6438827 | G | RECESSIVE | 0.044675 | >5 |
| CPNE4 | 653 | 9843898 | C | RECESSIVE | 0.029620 | 1.34 |
| EPHB1 | 658 | 9819372 | A | RECESSIVE | 0.019239 | 0.77 |
| SERPINI1 | 675 | 2229697 | A | DOMINANT | 0.047086 | 1.21 |
| SLC7A14 | 677 | 12496334 | C | ADDITIVE | 0.035840 | 0.85 |
| SLC7A14 | 678 | 17289598 | G | ADDITIVE | 0.031139 | 0.84 |
| TNIK | 679 | 6781167 | A | ADDITIVE | 0.029134 | 1.18 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| TNIK | 681 | 6445006 | A | RECESSIVE | 0.022127 | 0.71 |
| PLD1 | 688 | 187229 | T | DOMINANT | 0.049571 | 0.87 |
| PLD1 | 689 | 181715 | A | DOMINANT | 0.034263 | 0.86 |
| PLD1 | 690 | 360401 | T | DOMINANT | 0.046942 | 0.87 |
| PLD1 | 691 | 9822322 | T | DOMINANT | 0.015150 | 1.20 |
| PLD1 | 692 | 6781853 | C | DOMINANT | 0.014711 | 1.20 |
| PLD1 | 693 | 9881788 | G | DOMINANT | 0.009027 | 1.22 |
| PLD1 | 694 | 4894707 | T | DOMINANT | 0.013833 | 1.20 |
| PLD1 | 695 | 3774039 | T | DOMINANT | 0.015297 | 1.20 |
| PLD1 | 696 | 2290479 | G | DOMINANT | 0.011224 | 1.20 |
| PLD1 | 697 | 2290480 | A | ADDITIVE | 0.011886 | 1.16 |
| PLD1 | 698 | 7649974 | G | DOMINANT | 0.030944 | 1.18 |
| PLD1 | 699 | 6794454 | C | ADDITIVE | 0.002987 | 1.22 |
| PLD1 | 700 | 6769838 | G | RECESSIVE | 0.004606 | 0.77 |
| PLD1 | 701 | 13089252 | T | RECESSIVE | 0.001562 | 0.75 |
| NLGN1 | 702 | 1948162 | G | DOMINANT | 0.018084 | 0.83 |
| HTR3D | 707 | 7430671 | G | ADDITIVE | 0.025876 | 1.08 |
| LEPREL1 | 709 | 1447948 | A | RECESSIVE | 0.043390 | 0.70 |
| IL1RAP | 715 | 4624606 | A | ADDITIVE | 0.020796 | 0.87 |
| SLC2A9 | 719 | 7674711 | C | ADDITIVE | 0.017265 | 1.23 |
| SLC2A9 | 720 | 16890905 | T | ADDITIVE | 0.011312 | 1.24 |
| KCNIP4 | 735 | 16869851 | C | DOMINANT | 0.001438 | 1.30 |
| KCNIP4 | 736 | 2114474 | T | ADDITIVE | 0.022544 | 1.19 |
| KCNIP4 | 737 | 7689421 | A | ADDITIVE | 0.023300 | 1.17 |
| KCNIP4 | 738 | 7694208 | G | ADDITIVE | 0.044093 | 1.17 |
| KCNIP4 | 739 | 17623902 | A | RECESSIVE | 0.014218 | 0.76 |
| UBE2K | 744 | 7697939 | G | ADDITIVE | 0.024586 | 0.86 |
| LIMCH1 | 746 | 17528515 | C | DOMINANT | 0.019809 | 0.85 |
| LIMCH1 | 747 | 13134348 | A | RECESSIVE | 0.041170 | 1.52 |
| LIMCH1 | 748 | 6838113 | T | ADDITIVE | 0.002631 | 1.15 |
| LIMCH1 | 749 | 6447080 | G | ADDITIVE | 0.002666 | 1.16 |
| LIMCH1 | 750 | 6447081 | G | ADDITIVE | 0.002651 | 1.16 |
| LIMCH1 | 751 | 7671360 | T | ADDITIVE | 0.002916 | 1.14 |
| LIMCH1 | 752 | 7674935 | C | ADDITIVE | 0.036953 | 1.05 |
| LIMCH1 | 753 | 4266323 | T | ADDITIVE | 0.002949 | 1.15 |
| LIMCH1 | 754 | 4610372 | G | ADDITIVE | 0.000509 | 1.21 |
| LIMCH1 | 755 | 7683275 | G | ADDITIVE | 0.025159 | 1.10 |
| LIMCH1 | 756 | 4861118 | A | ADDITIVE | 0.001559 | 1.17 |
| LIMCH1 | 757 | 6838196 | C | ADDITIVE | 0.007764 | 1.14 |
| LIMCH1 | 758 | 6447088 | C | ADDITIVE | 0.002957 | 1.11 |
| LIMCH1 | 764 | 2304651 | A | DOMINANT | 0.042200 | 1.23 |
| LIMCH1 | 765 | 7674006 | C | DOMINANT | 0.011887 | 1.33 |
| LPHN3 | 766 | 10008326 | A | ADDITIVE | 0.022975 | 1.10 |
| LPHN3 | 767 | 1397548 | A | ADDITIVE | 0.029744 | 1.07 |
| SHROOM3 | 786 | 3821979 | A | RECESSIVE | 0.000811 | 0.34 |
| SHROOM3 | 787 | 12640170 | T | RECESSIVE | 0.004293 | 0.72 |
| SHROOM3 | 788 | 10013334 | T | RECESSIVE | 0.003336 | 0.42 |
| SHROOM3 | 789 | 11734394 | A | RECESSIVE | 0.007616 | 0.73 |
| GPRIN3 | 792 | 7653897 | A | DOMINANT | 0.018616 | 0.83 |
| GPRIN3 | 793 | 7690986 | G | DOMINANT | 0.033546 | 0.85 |
| GRID2 | 798 | 7668740 | T | RECESSIVE | 0.035881 | 0.79 |
| GRID2 | 802 | 2164314 | A | RECESSIVE | 0.032472 | 1.35 |
| GRID2 | 803 | 13123140 | C | RECESSIVE | 0.005195 | 1.29 |
| GRID2 | 804 | 4693331 | C | RECESSIVE | 0.004350 | 1.29 |
| GRID2 | 805 | 7671794 | A | RECESSIVE | 0.016565 | 1.33 |
| GRID2 | 806 | 11932367 | A | RECESSIVE | 0.018157 | 1.29 |
| GRID2 | 807 | 6837139 | C | DOMINANT | 0.030403 | 0.86 |
| UNC5C | 812 | 4529060 | A | DOMINANT | 0.039558 | 1.17 |
| UNC5C | 813 | 10856918 | G | DOMINANT | 0.005559 | 1.22 |
| UNC5C | 814 | 13121737 | C | DOMINANT | 0.001643 | 1.27 |
| UNC5C | 815 | 13134684 | T | DOMINANT | 0.000460 | 1.28 |
| UNC5C | 816 | 4103379 | G | DOMINANT | 0.001489 | 1.28 |
| UNC5C | 817 | 6834411 | G | DOMINANT | 0.001254 | 1.28 |
| UNC5C | 819 | 13148787 | A | DOMINANT | 0.000128 | 1.31 |
| PPP3CA | 821 | 2732507 | G | RECESSIVE | 0.033517 | 0.83 |
| PPP3CA | 822 | 2851048 | C | RECESSIVE | 0.039359 | 0.83 |
| PPP3CA | 823 | 2851062 | G | RECESSIVE | 0.003730 | 0.78 |
| PPP3CA | 824 | 2141145 | T | DOMINANT | 0.016846 | 1.21 |
| PPP3CA | 825 | 1405686 | T | DOMINANT | 0.021504 | 1.20 |
| COL25A1 | 835 | 11098004 | T | ADDITIVE | 0.033780 | 0.88 |
| COL25A1 | 836 | 1563004 | G | ADDITIVE | 0.022397 | 0.86 |
| ANK2 | 842 | 1026975 | G | DOMINANT | 0.024160 | 1.19 |
| ANK2 | 846 | 11942005 | G | ADDITIVE | 0.032895 | 1.15 |
| ANK2 | 847 | 29355 | G | ADDITIVE | 0.021642 | 1.23 |
| ANK2 | 848 | 29319 | A | ADDITIVE | 0.022271 | 1.21 |
| PRSS12 | 851 | 4834679 | T | DOMINANT | 0.009389 | 1.36 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| PRSS12 | 852 | 1514657 | A | DOMINANT | 0.023109 | 1.31 |
| PRSS12 | 853 | 2892812 | C | DOMINANT | 0.041795 | 1.27 |
| MAML3 | 854 | 6831959 | A | RECESSIVE | 0.003586 | 1.28 |
| MAML3 | 857 | 2604918 | A | RECESSIVE | 0.015325 | 0.77 |
| MAML3 | 862 | 6830177 | A | DOMINANT | 0.030418 | 1.17 |
| INPP4B | 878 | 13138212 | T | RECESSIVE | 0.018785 | 0.78 |
| INPP4B | 879 | 1497389 | T | RECESSIVE | 0.010774 | 0.76 |
| INPP4B | 880 | 881611 | G | RECESSIVE | 0.013646 | 0.78 |
| INPP4B | 881 | 6820463 | T | RECESSIVE | 0.005003 | 0.71 |
| INPP4B | 882 | 17715707 | G | RECESSIVE | 0.007255 | 0.72 |
| POU4F2 | 883 | 2174304 | A | ADDITIVE | 0.007872 | 0.81 |
| POU4F2 | 884 | 10010958 | T | ADDITIVE | 0.008797 | 0.82 |
| POU4F2 | 885 | 6821387 | A | ADDITIVE | 0.013700 | 0.87 |
| POU4F2 | 886 | 1104532 | A | ADDITIVE | 0.012404 | 0.83 |
| POU4F2 | 887 | 6835151 | A | ADDITIVE | 0.008051 | 0.81 |
| POU4F2 | 888 | 1394279 | C | ADDITIVE | 0.013437 | 0.82 |
| DCLK2 | 891 | 12374344 | T | ADDITIVE | 0.032894 | 0.88 |
| CTSO | 893 | 6854827 | G | DOMINANT | 0.034372 | 1.16 |
| CTSO | 894 | 6832480 | T | DOMINANT | 0.023229 | 1.18 |
| CTSO | 895 | 6536124 | T | DOMINANT | 0.020871 | 1.18 |
| FSTL5 | 897 | 6824038 | T | ADDITIVE | 0.043324 | 0.87 |
| FSTL5 | 898 | 1023957 | C | ADDITIVE | 0.042148 | 0.87 |
| FSTL5 | 899 | 13121013 | A | ADDITIVE | 0.038681 | 0.89 |
| FSTL5 | 900 | 17459954 | T | ADDITIVE | 0.041918 | 0.89 |
| FSTL5 | 901 | 2872800 | A | RECESSIVE | 0.015723 | 0.82 |
| FSTL5 | 902 | 7699959 | A | RECESSIVE | 0.004355 | 0.78 |
| FSTL5 | 903 | 10031537 | T | RECESSIVE | 0.000485 | 0.74 |
| FSTL5 | 904 | 7375994 | A | RECESSIVE | 0.000021 | 0.48 |
| FSTL5 | 905 | 13113862 | A | RECESSIVE | 0.000106 | 0.50 |
| FSTL5 | 906 | 4301062 | C | RECESSIVE | 0.000016 | 0.50 |
| FSTL5 | 907 | 4574362 | C | RECESSIVE | 0.003856 | 0.78 |
| FSTL5 | 908 | 13101933 | T | RECESSIVE | 0.000176 | 0.44 |
| FSTL5 | 909 | 4691039 | T | RECESSIVE | 0.001018 | 0.64 |
| PALLD | 922 | 6817551 | A | RECESSIVE | 0.003843 | 0.65 |
| PALLD | 923 | 3733656 | T | RECESSIVE | 0.000789 | 0.62 |
| PALLD | 924 | 10023864 | A | RECESSIVE | 0.002252 | 0.63 |
| PALLD | 925 | 1531254 | A | RECESSIVE | 0.008089 | 0.67 |
| PALLD | 926 | 11733251 | A | RECESSIVE | 0.005134 | 0.66 |
| PALLD | 927 | 10518037 | T | RECESSIVE | 0.002405 | 0.63 |
| ODZ3 | 930 | 10520541 | G | DOMINANT | 0.016402 | 0.83 |
| ODZ3 | 931 | 4862087 | G | DOMINANT | 0.012773 | 0.83 |
| ODZ3 | 932 | 17329750 | C | DOMINANT | 0.010690 | 0.82 |
| SEMA5A | 944 | 150633 | C | RECESSIVE | 0.024356 | 0.78 |
| CTNND2 | 947 | 13358276 | T | RECESSIVE | 0.000844 | 0.73 |
| CTNND2 | 950 | 27520 | C | RECESSIVE | 0.000179 | 1.38 |
| CTNND2 | 951 | 2530215 | C | RECESSIVE | 0.000031 | 1.43 |
| DNAH5 | 959 | 17203442 | G | RECESSIVE | 0.019214 | 0.59 |
| MYO10 | 963 | 10045328 | A | DOMINANT | 0.015841 | 1.75 |
| BASP1 | 964 | 2929726 | A | ADDITIVE | 0.004630 | 1.11 |
| BASP1 | 965 | 2956564 | G | ADDITIVE | 0.006795 | 1.10 |
| BASP1 | 966 | 2929710 | C | ADDITIVE | 0.007172 | 1.09 |
| CDH10 | 967 | 7719252 | G | DOMINANT | 0.008975 | 0.83 |
| CDH10 | 969 | 1395025 | C | DOMINANT | 0.005616 | 0.82 |
| C1QTNF3 | 971 | 840391 | G | RECESSIVE | 0.031427 | 0.81 |
| C1QTNF3 | 972 | 840381 | G | DOMINANT | 0.012639 | 1.19 |
| C1QTNF3 | 973 | 299620 | G | DOMINANT | 0.003622 | 0.81 |
| ITGA1 | 980 | 13189973 | T | RECESSIVE | 0.037140 | 0.69 |
| ITGA1 | 981 | 4865747 | T | RECESSIVE | 0.006946 | 0.49 |
| ITGA1 | 982 | 17209947 | A | RECESSIVE | 0.010415 | 0.51 |
| ITGA1 | 983 | 10513000 | G | RECESSIVE | 0.026389 | 0.74 |
| ITGA1 | 984 | 10513001 | G | RECESSIVE | 0.041671 | 0.76 |
| ITGA1 | 985 | 6886404 | C | RECESSIVE | 0.023463 | 0.73 |
| ITGA1 | 987 | 16876270 | C | ADDITIVE | 0.010615 | 1.52 |
| ITGA2 | 989 | 1421937 | C | RECESSIVE | 0.043339 | 0.76 |
| ITGA2 | 990 | 3212528 | A | RECESSIVE | 0.004249 | 3.74 |
| ITGA2 | 991 | 3212544 | T | RECESSIVE | 0.004262 | 3.74 |
| ITGA2 | 992 | 3212545 | A | RECESSIVE | 0.004271 | 3.74 |
| ITGA2 | 993 | 2303125 | G | RECESSIVE | 0.001769 | 4.68 |
| ITGA2 | 994 | 12521915 | G | RECESSIVE | 0.025294 | 0.79 |
| ITGA2 | 995 | 3212634 | C | RECESSIVE | 0.005785 | 4.05 |
| ITGA2 | 996 | 2303120 | A | RECESSIVE | 0.001769 | 4.68 |
| PIK3R1 | 1013 | 6881033 | G | RECESSIVE | 0.002456 | 0.78 |
| FCHO2 | 1017 | 6877485 | T | RECESSIVE | 0.028029 | 0.68 |
| PDE8B | 1026 | 6896093 | G | DOMINANT | 0.033112 | 0.86 |
| PDE8B | 1027 | 17671243 | A | DOMINANT | 0.026875 | 0.86 |
| PDE8B | 1028 | 11742730 | G | DOMINANT | 0.043594 | 0.87 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| PDE8B | 1029 | 11750661 | A | DOMINANT | 0.027770 | 0.86 |
| PDE8B | 1033 | 335635 | C | RECESSIVE | 0.007356 | 0.80 |
| CMYA5 | 1044 | 12654905 | G | DOMINANT | 0.010558 | 1.28 |
| CMYA5 | 1045 | 6880680 | G | DOMINANT | 0.011159 | 1.27 |
| CMYA5 | 1046 | 1541813 | G | DOMINANT | 0.004662 | 1.22 |
| CMYA5 | 1047 | 7719553 | A | DOMINANT | 0.000659 | 1.28 |
| CMYA5 | 1048 | 7734306 | T | DOMINANT | 0.000642 | 1.28 |
| CMYA5 | 1049 | 1991483 | G | DOMINANT | 0.003242 | 1.23 |
| CMYA5 | 1051 | 259064 | C | RECESSIVE | 0.002122 | 2.51 |
| MEF2C | 1052 | 454214 | G | DOMINANT | 0.040096 | 1.17 |
| MEF2C | 1053 | 618298 | T | DOMINANT | 0.034471 | 1.17 |
| MEF2C | 1054 | 625970 | A | DOMINANT | 0.036148 | 1.17 |
| MEF2C | 1055 | 681446 | A | DOMINANT | 0.040327 | 1.17 |
| MEF2C | 1056 | 679232 | G | DOMINANT | 0.042695 | 1.17 |
| GPR98 | 1061 | 27657 | T | RECESSIVE | 0.002882 | 2.39 |
| GPR98 | 1062 | 40205 | C | RECESSIVE | 0.007956 | 2.11 |
| GPR98 | 1064 | 10070074 | C | RECESSIVE | 0.030660 | 0.80 |
| GPR98 | 1065 | 2460177 | G | DOMINANT | 0.021205 | 1.18 |
| GPR98 | 1066 | 2222244 | A | DOMINANT | 0.005160 | 1.22 |
| GPR98 | 1068 | 16869425 | C | RECESSIVE | 0.018577 | 2.67 |
| GPR98 | 1069 | 1852731 | C | RECESSIVE | 0.009231 | 2.75 |
| FBXL17 | 1070 | 288180 | T | RECESSIVE | 0.000857 | 0.48 |
| FBXL17 | 1071 | 288173 | C | RECESSIVE | 0.008117 | 0.57 |
| FBXL17 | 1072 | 288172 | G | RECESSIVE | 0.001858 | 0.50 |
| FBXL17 | 1073 | 288146 | A | RECESSIVE | 0.011604 | 0.65 |
| FBXL17 | 1074 | 288144 | A | RECESSIVE | 0.001779 | 0.50 |
| FBXL17 | 1075 | 288139 | T | RECESSIVE | 0.013779 | 0.66 |
| FBXL17 | 1076 | 286753 | T | RECESSIVE | 0.011156 | 0.65 |
| FBXL17 | 1077 | 289227 | C | RECESSIVE | 0.003804 | 0.53 |
| FBXL17 | 1078 | 34428 | T | RECESSIVE | 0.005606 | 0.56 |
| FBXL17 | 1079 | 286769 | T | RECESSIVE | 0.008358 | 0.61 |
| FBXL17 | 1080 | 17385448 | T | RECESSIVE | 0.009082 | 0.60 |
| PJA2 | 1081 | 1862204 | C | DOMINANT | 0.001308 | 1.27 |
| PJA2 | 1082 | 784291 | T | DOMINANT | 0.002544 | 1.25 |
| PJA2 | 1083 | 11738695 | C | DOMINANT | 0.002528 | 1.25 |
| PJA2 | 1084 | 246103 | G | DOMINANT | 0.006431 | 1.22 |
| PJA2 | 1085 | 2963024 | C | DOMINANT | 0.005544 | 1.22 |
| PJA2 | 1086 | 2963046 | T | DOMINANT | 0.008465 | 1.21 |
| PJA2 | 1087 | 2914705 | A | DOMINANT | 0.005301 | 1.22 |
| PJA2 | 1088 | 2963028 | C | DOMINANT | 0.004163 | 1.24 |
| PJA2 | 1089 | 2963029 | C | DOMINANT | 0.005706 | 1.22 |
| PJA2 | 1090 | 2963031 | A | DOMINANT | 0.001640 | 1.25 |
| PJA2 | 1091 | 2963034 | A | DOMINANT | 0.004623 | 1.22 |
| PJA2 | 1092 | 2963013 | C | DOMINANT | 0.005696 | 1.22 |
| PJA2 | 1093 | 12514259 | C | DOMINANT | 0.018478 | 1.19 |
| ADAMTS19 | 1098 | 13158524 | A | ADDITIVE | 0.025048 | 1.10 |
| ADAMTS19 | 1099 | 1017201 | T | ADDITIVE | 0.033907 | 1.11 |
| ADAMTS19 | 1100 | 1972624 | T | ADDITIVE | 0.011041 | 1.10 |
| ADAMTS19 | 1101 | 30710 | T | ADDITIVE | 0.009705 | 1.09 |
| ADAMTS19 | 1102 | 30671 | C | ADDITIVE | 0.005393 | 1.11 |
| ADAMTS19 | 1103 | 25820 | A | ADDITIVE | 0.001422 | 1.14 |
| ADAMTS19 | 1104 | 30669 | G | ADDITIVE | 0.013109 | 1.11 |
| ADAMTS19 | 1105 | 30665 | G | ADDITIVE | 0.002654 | 1.11 |
| ADAMTS19 | 1106 | 30664 | G | ADDITIVE | 0.007485 | 1.10 |
| ADAMTS19 | 1107 | 30651 | C | ADDITIVE | 0.014300 | 1.10 |
| ADAMTS19 | 1108 | 4835975 | A | RECESSIVE | 0.009838 | 1.30 |
| VDAC1 | 1110 | 2066944 | T | ADDITIVE | 0.026128 | 1.21 |
| VDAC1 | 1112 | 4958172 | A | DOMINANT | 0.022243 | 1.22 |
| TRPC7 | 1113 | 7732110 | A | ADDITIVE | 0.000694 | 1.17 |
| TRPC7 | 1114 | 3734125 | G | ADDITIVE | 0.001041 | 1.15 |
| TRPC7 | 1115 | 10045073 | G | ADDITIVE | 0.001245 | 1.14 |
| TRPC7 | 1116 | 10060256 | A | RECESSIVE | 0.022267 | 4.85 |
| TRPC7 | 1117 | 7727558 | G | ADDITIVE | 0.000761 | 1.20 |
| TRPC7 | 1118 | 4976485 | A | ADDITIVE | 0.010429 | 0.88 |
| TRPC7 | 1119 | 10070699 | G | ADDITIVE | 0.013025 | 0.87 |
| TRPC7 | 1120 | 3777145 | T | ADDITIVE | 0.015531 | 1.16 |
| TRPC7 | 1121 | 4976368 | A | ADDITIVE | 0.013223 | 0.87 |
| TRPC7 | 1122 | 3822748 | T | ADDITIVE | 0.013223 | 0.87 |
| TRPC7 | 1123 | 950714 | G | ADDITIVE | 0.015531 | 1.16 |
| TRPC7 | 1124 | 953096 | C | ADDITIVE | 0.011542 | 0.85 |
| TRPC7 | 1125 | 2649691 | A | ADDITIVE | 0.006170 | 1.16 |
| TRPC7 | 1126 | 963590 | C | ADDITIVE | 0.014941 | 0.83 |
| TRPC7 | 1127 | 2673926 | T | ADDITIVE | 0.000043 | 1.23 |
| TRPC7 | 1128 | 2673925 | T | ADDITIVE | 0.000050 | 1.24 |
| TRPC7 | 1129 | 2649696 | G | ADDITIVE | 0.000108 | 1.21 |
| GRIA1 | 1130 | 2452801 | G | ADDITIVE | 0.030501 | 1.09 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| GRIA1 | 1132 | 778825 | A | RECESSIVE | 0.040823 | 1.24 |
| ODZ2 | 1135 | 11134468 | G | RECESSIVE | 0.006592 | 0.38 |
| ODZ2 | 1136 | 7737681 | A | RECESSIVE | 0.023441 | 0.55 |
| ODZ2 | 1137 | 1549152 | C | RECESSIVE | 0.009367 | 0.48 |
| ODZ2 | 1139 | 2546957 | C | RECESSIVE | 0.035689 | 1.26 |
| ODZ2 | 1142 | 1960425 | T | DOMINANT | 0.009361 | 1.22 |
| ODZ2 | 1143 | 10447203 | A | ADDITIVE | 0.005199 | 1.17 |
| ODZ2 | 1144 | 11748886 | G | RECESSIVE | 0.017496 | >5 |
| WWC1 | 1145 | 11748902 | G | RECESSIVE | 0.004500 | >5 |
| WWC1 | 1148 | 10038727 | A | ADDITIVE | 0.034029 | 0.91 |
| WWC1 | 1149 | 4576167 | C | ADDITIVE | 0.030218 | 0.91 |
| KCNIP1 | 1151 | 906361 | A | ADDITIVE | 0.000597 | 0.81 |
| KCNIP1 | 1152 | 906359 | G | ADDITIVE | 0.000882 | 0.81 |
| KCNIP1 | 1153 | 906358 | A | ADDITIVE | 0.000903 | 0.81 |
| KCNIP1 | 1155 | 6555913 | G | RECESSIVE | 0.007000 | 1.29 |
| EXOC2 | 1159 | 6597037 | A | ADDITIVE | 0.029028 | 1.25 |
| EXOC2 | 1160 | 9503977 | C | ADDITIVE | 0.038101 | 1.18 |
| EXOC2 | 1161 | 4959273 | A | ADDITIVE | 0.010099 | 1.23 |
| EXOC2 | 1163 | 6940427 | A | ADDITIVE | 0.038202 | 1.14 |
| EXOC2 | 1164 | 1766835 | C | ADDITIVE | 0.020589 | 1.15 |
| EXOC2 | 1165 | 4960092 | G | ADDITIVE | 0.007911 | 1.18 |
| EXOC2 | 1166 | 2013853 | G | ADDITIVE | 0.030903 | 1.14 |
| EXOC2 | 1167 | 1747586 | A | ADDITIVE | 0.016906 | 1.14 |
| SERPINB6 | 1169 | 7751676 | T | DOMINANT | 0.007640 | 1.32 |
| SERPINB6 | 1170 | 1358869 | C | ADDITIVE | 0.013337 | 1.25 |
| ATXN1 | 1186 | 2237166 | C | RECESSIVE | 0.020335 | 1.21 |
| ATXN1 | 1187 | 2237164 | G | RECESSIVE | 0.019501 | 1.22 |
| ATXN1 | 1188 | 2073516 | T | ADDITIVE | 0.034126 | 1.18 |
| ATXN1 | 1189 | 909786 | G | ADDITIVE | 0.027054 | 1.15 |
| ATXN1 | 1190 | 760882 | A | ADDITIVE | 0.002167 | 1.19 |
| ATXN1 | 1191 | 6921608 | C | DOMINANT | 0.005835 | 1.22 |
| ATXN1 | 1192 | 719316 | G | ADDITIVE | 0.000348 | 1.31 |
| ATXN1 | 1193 | 1570487 | T | DOMINANT | 0.005962 | 1.22 |
| ATXN1 | 1194 | 11754887 | C | DOMINANT | 0.013713 | 1.19 |
| ATXN1 | 1195 | 1144695 | A | ADDITIVE | 0.020507 | 1.19 |
| SLC17A4 | 1196 | 4712972 | A | DOMINANT | 0.017749 | 0.82 |
| SLC17A4 | 1197 | 1892252 | G | DOMINANT | 0.010305 | 0.81 |
| SLC17A1 | 1199 | 1324082 | A | DOMINANT | 0.014663 | 0.84 |
| SLC17A1 | 1200 | 1165196 | C | ADDITIVE | 0.040499 | 1.00 |
| SLC17A1 | 1201 | 12182983 | A | DOMINANT | 0.024179 | 0.85 |
| SLC17A1 | 1202 | 6913879 | C | DOMINANT | 0.018099 | 0.85 |
| SLC17A1 | 1203 | 6905614 | C | ADDITIVE | 0.009533 | 1.11 |
| SLC17A1 | 1204 | 1324088 | T | DOMINANT | 0.032943 | 0.84 |
| SLC17A3 | 1205 | 1182814 | G | ADDITIVE | 0.003071 | 0.82 |
| SLC17A3 | 1206 | 1165165 | A | ADDITIVE | 0.001545 | 0.80 |
| SLC17A3 | 1207 | 1165162 | A | ADDITIVE | 0.003673 | 0.83 |
| SLC17A3 | 1208 | 1165158 | T | ADDITIVE | 0.003926 | 0.83 |
| SLC17A3 | 1209 | 1165207 | A | ADDITIVE | 0.006364 | 1.09 |
| SLC17A3 | 1210 | 523383 | C | DOMINANT | 0.037395 | 0.84 |
| SLC17A3 | 1211 | 1165205 | A | ADDITIVE | 0.006296 | 1.09 |
| BTN3A1 | 1212 | 4712986 | G | RECESSIVE | 0.012582 | 1.91 |
| BTN3A1 | 1213 | 12208788 | A | RECESSIVE | 0.009747 | 2.04 |
| BTN3A1 | 1215 | 10807008 | C | ADDITIVE | 0.034023 | 1.15 |
| BTN3A1 | 1216 | 17610161 | A | RECESSIVE | 0.038234 | 2.07 |
| MSH5 | 1218 | 707937 | C | RECESSIVE | 0.019603 | 0.65 |
| LRFN2 | 1219 | 846505 | T | DOMINANT | 0.035993 | 0.85 |
| PARC | 1222 | 6938026 | G | DOMINANT | 0.034030 | 0.85 |
| TRDN | 1240 | 1890467 | C | RECESSIVE | 0.023215 | 0.49 |
| TRDN | 1241 | 9372744 | G | RECESSIVE | 0.012248 | 0.48 |
| TRDN | 1242 | 1431291 | G | RECESSIVE | 0.010469 | 0.45 |
| TRDN | 1243 | 7765003 | A | RECESSIVE | 0.015667 | 0.47 |
| TRDN | 1248 | 6931183 | A | DOMINANT | 0.019725 | 1.21 |
| NKAIN2 | 1261 | 6906607 | A | ADDITIVE | 0.042731 | 1.14 |
| EYA4 | 1262 | 2027210 | A | DOMINANT | 0.004507 | 1.25 |
| EYA4 | 1263 | 17301622 | G | DOMINANT | 0.000543 | 1.32 |
| EYA4 | 1264 | 7454561 | G | DOMINANT | 0.004285 | 1.25 |
| EYA4 | 1265 | 12524250 | A | DOMINANT | 0.004121 | 1.25 |
| PDE7B | 1269 | 9389370 | G | ADDITIVE | 0.011134 | 0.88 |
| PDE7B | 1270 | 6931460 |  | ADDITIVE | 0.031841 | 0.58 |
| PLAGL1 | 1271 | 11155338 | T | DOMINANT | 0.005488 | 1.22 |
| STX11 | 1273 | 6935462 | A | ADDITIVE | 0.006308 | 1.39 |
| UTRN | 1274 | 6906465 | G | ADDITIVE | 0.002849 | 1.23 |
| UTRN | 1275 | 9373430 | A | DOMINANT | 0.039224 | 1.16 |
| PARK2 | 1283 | 2064419 | T | RECESSIVE | 0.027128 | 1.20 |
| PARK2 | 1284 | 9364602 | A | RECESSIVE | 0.020631 | 1.25 |
| PACRG | 1285 | 2763986 | T | RECESSIVE | 0.000018 | 0.68 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| PACRG | 1286 | 761625 | A | RECESSIVE | 0.000138 | 0.71 |
| PDE10A | 1294 | 481701 | C | RECESSIVE | 0.015732 | 2.29 |
| NXPH1 | 1298 | 10085720 | T | DOMINANT | 0.032211 | 0.86 |
| NXPH1 | 1299 | 4455737 | G | DOMINANT | 0.041509 | 0.87 |
| NXPH1 | 1300 | 7456267 | A | DOMINANT | 0.039360 | 0.86 |
| NXPH1 | 1301 | 2349499 | C | DOMINANT | 0.020655 | 0.85 |
| NXPH1 | 1302 | 10257265 | C | DOMINANT | 0.034891 | 0.86 |
| NXPH1 | 1303 | 970526 | G | DOMINANT | 0.034780 | 0.86 |
| NXPH1 | 1304 | 970527 | C | DOMINANT | 0.011590 | 0.83 |
| NXPH1 | 1305 | 3779355 | A | ADDITIVE | 0.029694 | 0.84 |
| DGKB | 1307 | 17167942 | A | DOMINANT | 0.003092 | 1.24 |
| DGKB | 1308 | 6969690 | G | DOMINANT | 0.007030 | 1.22 |
| DGKB | 1311 | 12699645 | C | ADDITIVE | 0.011602 | 0.91 |
| DGKB | 1312 | 2049447 | C | ADDITIVE | 0.007679 | 0.91 |
| DGKB | 1314 | 1981680 | T | RECESSIVE | 0.017378 | 0.73 |
| DGKB | 1316 | 10277367 | C | RECESSIVE | 0.033853 | 0.76 |
| SNX13 | 1318 | 4543441 | A | ADDITIVE | 0.027678 | 0.98 |
| SNX13 | 1319 | 4544985 | C | ADDITIVE | 0.033053 | 0.97 |
| SNX13 | 1320 | 6970593 | A | ADDITIVE | 0.030068 | 0.97 |
| STK31 | 1323 | 13244337 | G | RECESSIVE | 0.018236 | 1.55 |
| CREB5 | 1330 | 2237361 | C | DOMINANT | 0.043164 | 1.16 |
| PDE1C | 1335 | 7791180 | G | DOMINANT | 0.034376 | 1.16 |
| PDE1C | 1336 | 10951305 | T | DOMINANT | 0.049127 | 1.15 |
| PDE1C | 1337 | 4723103 | T | DOMINANT | 0.018831 | 1.18 |
| PDE1C | 1338 | 3801350 | T | DOMINANT | 0.001524 | 1.25 |
| PDE1C | 1339 | 12701142 | G | DOMINANT | 0.001375 | 1.25 |
| BMPER | 1340 | 1365883 | T | RECESSIVE | 0.029436 | 0.71 |
| BMPER | 1341 | 13244436 | A | RECESSIVE | 0.043482 | 0.73 |
| BMPER | 1342 | 2110856 | C | RECESSIVE | 0.033499 | 0.72 |
| BMPER | 1343 | 12672492 | A | RECESSIVE | 0.033499 | 0.72 |
| EEPD1 | 1345 | 2726113 | T | RECESSIVE | 0.011127 | 1.66 |
| VPS41 | 1349 | 2240355 | A | ADDITIVE | 0.029219 | 1.13 |
| VPS41 | 1350 | 10262154 | T | RECESSIVE | 0.048068 | 0.82 |
| VPS41 | 1353 | 10279367 | A | RECESSIVE | 0.004238 | 0.71 |
| VPS41 | 1360 | 4723793 | G | DOMINANT | 0.047847 | 1.15 |
| VPS41 | 1361 | 17680408 | A | RECESSIVE | 0.006066 | 0.72 |
| VPS41 | 1366 | 10951578 | C | RECESSIVE | 0.009675 | 0.77 |
| VPS41 | 1367 | 10255290 | A | RECESSIVE | 0.035368 | 0.77 |
| VPS41 | 1368 | 10255854 | T | RECESSIVE | 0.036509 | 0.77 |
| ABCA13 | 1373 | 17661073 | C | ADDITIVE | 0.009969 | 1.26 |
| ABCA13 | 1374 | 17132158 | G | ADDITIVE | 0.010967 | 1.25 |
| ABCA13 | 1377 | 17132163 | T | ADDITIVE | 0.031656 | 1.16 |
| ABCA13 | 1378 | 12113721 | A | ADDITIVE | 0.028846 | 1.20 |
| ABCA13 | 1379 | 2049514 | T | ADDITIVE | 0.030707 | 1.17 |
| ABCA13 | 1380 | 6583461 | A | DOMINANT | 0.010862 | 0.82 |
| ABCA13 | 1381 | 2049513 | A | ADDITIVE | 0.030583 | 1.19 |
| ABCA13 | 1382 | 11977113 | A | ADDITIVE | 0.039820 | 1.15 |
| ABCA13 | 1383 | 7802110 | G | ADDITIVE | 0.024160 | 0.86 |
| ABCA13 | 1384 | 7778020 | A | DOMINANT | 0.004982 | 0.77 |
| ABCA13 | 1385 | 4072503 | G | ADDITIVE | 0.026352 | 0.81 |
| ABCA13 | 1386 | 1317162 | C | ADDITIVE | 0.027645 | 0.80 |
| ABCA13 | 1387 | 12113920 | T | ADDITIVE | 0.026352 | 0.81 |
| ABCA13 | 1388 | 1918596 | T | ADDITIVE | 0.035153 | 0.81 |
| ABCA13 | 1389 | 1918588 | A | ADDITIVE | 0.022262 | 0.81 |
| ABCA13 | 1390 | 4144067 | T | ADDITIVE | 0.046224 | 0.82 |
| ABCA13 | 1391 | 7802150 | A | ADDITIVE | 0.029891 | 0.79 |
| ABCA13 | 1392 | 6965361 | T | ADDITIVE | 0.015271 | 0.76 |
| GRB10 | 1393 | 2244372 | G | DOMINANT | 0.004744 | 0.81 |
| GRB10 | 1394 | 2244353 | T | DOMINANT | 0.004277 | 0.80 |
| GRB10 | 1395 | 2244351 | G | DOMINANT | 0.004587 | 0.81 |
| GRB10 | 1396 | 2244347 | C | DOMINANT | 0.015688 | 0.84 |
| GRB10 | 1397 | 2237477 | T | DOMINANT | 0.005297 | 0.82 |
| GRB10 | 1398 | 2282931 | T | DOMINANT | 0.013027 | 0.83 |
| WBSCR17 | 1418 | 1001835 | A | ADDITIVE | 0.009100 | 1.20 |
| CALN1 | 1431 | 1914386 | T | RECESSIVE | 0.026272 | 3.24 |
| GTF2IRD1 | 1437 | 6953789 | A | DOMINANT | 0.016620 | 1.19 |
| MAGI2 | 1438 | 1860538 | G | DOMINANT | 0.013668 | 1.21 |
| MAGI2 | 1439 | 2075013 | C | DOMINANT | 0.011336 | 1.21 |
| MAGI2 | 1440 | 2075014 | T | RECESSIVE | 0.022202 | 0.80 |
| MAGI2 | 1445 | 7778707 | G | DOMINANT | 0.042255 | 0.85 |
| MAGI2 | 1446 | 1918935 | A | DOMINANT | 0.019166 | 0.83 |
| GRM3 | 1459 | 10239714 | C | ADDITIVE | 0.044664 | 1.14 |
| GRM3 | 1460 | 10280549 | A | ADDITIVE | 0.035220 | 1.16 |
| GRM3 | 1461 | 2299219 | C | ADDITIVE | 0.035472 | 1.16 |
| GRM3 | 1462 | 7804907 | T | ADDITIVE | 0.031061 | 1.19 |
| ADAM22 | 1463 | 1201841 | G | ADDITIVE | 0.041241 | 0.78 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| ADAM22 | 1464 | 7799148 | C | RECESSIVE | 0.034290 | 1.21 |
| PPP1R9A | 1475 | 2285694 | A | RECESSIVE | 0.044675 | >5 |
| CUX1 | 1484 | 1725604 | C | ADDITIVE | 0.000141 | 1.26 |
| CUX1 | 1485 | 2257738 | A | DOMINANT | 0.000605 | 1.27 |
| NRCAM | 1487 | 409797 | C | DOMINANT | 0.011478 | 1.20 |
| NRCAM | 1488 | 441468 | C | RECESSIVE | 0.044038 | 0.60 |
| NRCAM | 1490 | 2284280 | A | DOMINANT | 0.005295 | 1.22 |
| NRCAM | 1491 | 404287 | C | DOMINANT | 0.001819 | 1.25 |
| NRCAM | 1492 | 369800 | G | DOMINANT | 0.003476 | 1.24 |
| NRCAM | 1493 | 425013 | C | DOMINANT | 0.003512 | 1.23 |
| NRCAM | 1494 | 2023503 | G | RECESSIVE | 0.021159 | 0.79 |
| KCND2 | 1498 | 802372 | C | DOMINANT | 0.009167 | 1.29 |
| KCND2 | 1499 | 10488302 | A | DOMINANT | 0.013025 | 1.30 |
| CADPS2 | 1501 | 10267604 | G | DOMINANT | 0.002823 | 0.81 |
| CADPS2 | 1502 | 1154609 | C | DOMINANT | 0.003229 | 0.81 |
| CADPS2 | 1503 | 916982 | G | DOMINANT | 0.028635 | 0.85 |
| DGKI | 1538 | 834054 | T | ADDITIVE | 0.022104 | 0.45 |
| CREB3L2 | 1541 | 1020961 | T | DOMINANT | 0.005991 | 0.82 |
| CREB3L2 | 1542 | 9757 | G | DOMINANT | 0.007309 | 0.82 |
| CREB3L2 | 1543 | 13232124 | T | RECESSIVE | 0.003506 | 0.74 |
| CREB3L2 | 1544 | 11972734 | A | RECESSIVE | 0.004367 | 0.74 |
| TBXAS1 | 1545 | 2267705 | C | ADDITIVE | 0.037511 | 1.14 |
| TBXAS1 | 1546 | 2269997 | T | ADDITIVE | 0.011752 | 1.30 |
| PTPRN2 | 1585 | 4909289 | A | ADDITIVE | 0.047024 | 1.12 |
| CSMD1 | 1587 | 688894 | G | DOMINANT | 0.028176 | 0.85 |
| MCPH1 | 1597 | 12546890 | G | RECESSIVE | 0.028336 | 1.85 |
| MCPH1 | 1601 | 11989215 | G | DOMINANT | 0.034417 | 0.86 |
| MCPH1 | 1602 | 1375668 | G | ADDITIVE | 0.002813 | 0.81 |
| MCPH1 | 1603 | 4455855 | A | ADDITIVE | 0.007836 | 0.81 |
| ANGPT2 | 1609 | 7825811 | T | ADDITIVE | 0.009640 | 0.78 |
| DLC1 | 1610 | 7824944 | C | ADDITIVE | 0.041485 | 0.89 |
| SLC7A2 | 1619 | 2720590 | T | RECESSIVE | 0.020977 | 1.38 |
| PSD3 | 1621 | 13259407 | C | RECESSIVE | 0.025522 | 1.24 |
| PSD3 | 1623 | 1386688 | C | DOMINANT | 0.000444 | 1.31 |
| PSD3 | 1624 | 7837572 | T | DOMINANT | 0.000813 | 1.29 |
| ATP6V1B2 | 1626 | 1106634 | A | ADDITIVE | 0.000158 | 1.30 |
| PEBP4 | 1637 | 2466195 | C | RECESSIVE | 0.032095 | 1.40 |
| SLC25A37 | 1639 | 3736032 | A | RECESSIVE | 0.006306 | 6.08 |
| SLC25A37 | 1640 | 10104250 | T | RECESSIVE | 0.011315 | 8.91 |
| SLC25A37 | 1641 | 10092233 | G | RECESSIVE | 0.007312 | 9.72 |
| UNC5D | 1648 | 4739429 | G | ADDITIVE | 0.035910 | 1.11 |
| UNC5D | 1649 | 2843933 | T | RECESSIVE | 0.025249 | 1.21 |
| SFRP1 | 1650 | 13276051 | G | RECESSIVE | 0.011594 | 0.71 |
| SFRP1 | 1652 | 7843510 | G | RECESSIVE | 0.039906 | 0.83 |
| PRKDC | 1653 | 7841661 | G | DOMINANT | 0.032346 | 1.28 |
| SNTG1 | 1655 | 1486258 | G | RECESSIVE | 0.015905 | 1.47 |
| SNTG1 | 1658 | 2385554 | T | RECESSIVE | 0.022557 | 1.44 |
| SNTG1 | 1666 | 900958 | T | ADDITIVE | 0.022660 | 1.10 |
| SNTG1 | 1669 | 13260265 | C | ADDITIVE | 0.044904 | 0.87 |
| SNTG1 | 1670 | 12548940 | C | RECESSIVE | 0.033654 | 0.70 |
| TOX | 1679 | 6471757 | G | RECESSIVE | 0.009022 | 1.28 |
| TOX | 1680 | 4738738 | C | DOMINANT | 0.034348 | 0.86 |
| NKAIN3 | 1684 | 1993125 | C | ADDITIVE | 0.035728 | 0.87 |
| NKAIN3 | 1686 | 11787352 | A | ADDITIVE | 0.047193 | 0.89 |
| NKAIN3 | 1687 | 9298070 | G | RECESSIVE | 0.031088 | 1.22 |
| NKAIN3 | 1688 | 10100456 | T | RECESSIVE | 0.018065 | 1.33 |
| DEPDC2 | 1689 | 1434763 | C | RECESSIVE | 0.004902 | 0.75 |
| DEPDC2 | 1690 | 1434764 | A | RECESSIVE | 0.014905 | 0.79 |
| DEPDC2 | 1691 | 1014663 | C | RECESSIVE | 0.043302 | 0.82 |
| KCNB2 | 1692 | 13251896 | G | DOMINANT | 0.034554 | 0.85 |
| MMP16 | 1709 | 10106275 | A | RECESSIVE | 0.007120 | 0.79 |
| MMP16 | 1712 | 10504845 | T | DOMINANT | 0.026150 | 1.18 |
| GRHL2 | 1716 | 6992430 | G | DOMINANT | 0.008103 | 1.22 |
| GRHL2 | 1717 | 1357984 | A | DOMINANT | 0.006790 | 1.22 |
| GRHL2 | 1718 | 13275653 | C | DOMINANT | 0.011414 | 1.21 |
| GRHL2 | 1719 | 4734567 | A | RECESSIVE | 0.001421 | 1.56 |
| GRHL2 | 1720 | 4734038 | T | RECESSIVE | 0.002126 | 1.36 |
| GRHL2 | 1721 | 4734573 | G | RECESSIVE | 0.004418 | 1.38 |
| GRHL2 | 1722 | 3735715 | G | RECESSIVE | 0.000255 | 1.43 |
| GRHL2 | 1723 | 11994917 | T | RECESSIVE | 0.000743 | 1.40 |
| NCALD | 1724 | 1131862 | G | ADDITIVE | 0.027108 | 1.14 |
| NCALD | 1725 | 4734584 | A | RECESSIVE | 0.004912 | 1.37 |
| NCALD | 1726 | 12681368 | C | RECESSIVE | 0.001008 | 1.38 |
| NCALD | 1727 | 2226401 | G | RECESSIVE | 0.023428 | 1.43 |
| NCALD | 1728 | 6468791 | C | RECESSIVE | 0.001319 | 1.37 |
| NCALD | 1729 | 7829690 | T | ADDITIVE | 0.004749 | 1.07 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| ZFPM2 | 1730 | 7816536 | G | DOMINANT | 0.009659 | 0.83 |
| ZFPM2 | 1731 | 10464844 | G | DOMINANT | 0.010500 | 0.83 |
| ZFPM2 | 1732 | 1383591 | C | DOMINANT | 0.008786 | 0.83 |
| ZFPM2 | 1733 | 11988529 | C | DOMINANT | 0.008141 | 0.83 |
| ZFPM2 | 1734 | 1383592 | A | DOMINANT | 0.008265 | 0.83 |
| ZFPM2 | 1735 | 16873003 | C | DOMINANT | 0.003674 | 0.81 |
| ZFPM2 | 1736 | 4734863 | G | DOMINANT | 0.006262 | 0.82 |
| ZFPM2 | 1737 | 7823133 | T | DOMINANT | 0.006442 | 0.82 |
| ZFPM2 | 1738 | 6992053 | A | DOMINANT | 0.008970 | 0.83 |
| ZFPM2 | 1739 | 1481026 | T | DOMINANT | 0.008876 | 0.83 |
| ZFPM2 | 1740 | 6981187 | G | DOMINANT | 0.008594 | 0.83 |
| ZFPM2 | 1741 | 7007352 | G | RECESSIVE | 0.020585 | 0.40 |
| CSMD3 | 1763 | 4876502 | C | DOMINANT | 0.049394 | 1.17 |
| SAMD12 | 1766 | 4876815 | G | DOMINANT | 0.004186 | 0.81 |
| SAMD12 | 1767 | 13263320 | A | DOMINANT | 0.016429 | 1.20 |
| FER1L6 | 1771 | 4355755 | T | RECESSIVE | 0.009814 | 1.44 |
| FER1L6 | 1772 | 16893054 | T | RECESSIVE | 0.006023 | 1.48 |
| FER1L6 | 1773 | 4870877 | T | ADDITIVE | 0.001558 | 1.08 |
| FER1L6 | 1774 | 4871437 | C | ADDITIVE | 0.027223 | 1.06 |
| FER1L6 | 1775 | 7838453 | A | ADDITIVE | 0.034326 | 1.07 |
| FER1L6 | 1776 | 7842762 | C | ADDITIVE | 0.043442 | 1.03 |
| MTSS1 | 1781 | 3901290 | C | ADDITIVE | 0.017417 | 1.24 |
| MTSS1 | 1782 | 10956198 | G | DOMINANT | 0.017463 | 1.20 |
| COL22A1 | 1789 | 6577934 | A | DOMINANT | 0.005571 | 1.26 |
| COL22A1 | 1790 | 7017524 | A | DOMINANT | 0.010750 | 1.24 |
| COL22A1 | 1792 | 7818881 | C | RECESSIVE | 0.007364 | 0.80 |
| COL22A1 | 1793 | 10090299 | C | RECESSIVE | 0.010095 | 0.81 |
| COL22A1 | 1794 | 7838300 | C | RECESSIVE | 0.010325 | 0.81 |
| COL22A1 | 1795 | 7838450 | C | RECESSIVE | 0.010221 | 0.81 |
| SMARCA2 | 1803 | 13288443 | G | ADDITIVE | 0.022779 | 0.83 |
| SMARCA2 | 1804 | 7035991 | T | ADDITIVE | 0.024016 | 0.84 |
| SMARCA2 | 1805 | 3829070 | C | RECESSIVE | 0.028265 | 2.14 |
| SMARCA2 | 1808 | 10738600 | T | DOMINANT | 0.004771 | 0.81 |
| KIAA1797 | 1821 | 7021708 | G | RECESSIVE | 0.038416 | 1.24 |
| KIAA1797 | 1823 | 10511687 | G | RECESSIVE | 0.019549 | 1.29 |
| IFT74 | 1830 | 7035755 | G | DOMINANT | 0.015964 | 1.22 |
| IFT74 | 1831 | 7039400 | A | DOMINANT | 0.017917 | 1.22 |
| IFT74 | 1834 | 10812518 | T | RECESSIVE | 0.019272 | 1.58 |
| IFT74 | 1835 | 17694631 | C | DOMINANT | 0.013654 | 1.24 |
| IFT74 | 1836 | 2095405 | C | DOMINANT | 0.032978 | 1.17 |
| TEK | 1837 | 1591355 | G | DOMINANT | 0.037968 | 1.17 |
| PIP5K1B | 1839 | 7861710 | C | RECESSIVE | 0.026362 | 1.27 |
| PIP5K1B | 1840 | 4237268 | G | RECESSIVE | 0.049598 | 1.23 |
| TMC1 | 1857 | 7044235 | A | DOMINANT | 0.041657 | 0.85 |
| TMC1 | 1858 | 7044241 | A | DOMINANT | 0.028447 | 0.84 |
| TMC1 | 1859 | 7855743 | G | DOMINANT | 0.021116 | 0.83 |
| TMC1 | 1860 | 4373587 | T | DOMINANT | 0.030872 | 0.85 |
| TMC1 | 1861 | 13285932 | T | DOMINANT | 0.008895 | 1.21 |
| TMC1 | 1862 | 969205 | A | RECESSIVE | 0.010827 | 0.59 |
| TMC1 | 1863 | 1663740 | T | RECESSIVE | 0.008185 | 0.58 |
| TMC1 | 1864 | 1796991 | G | RECESSIVE | 0.008851 | 0.58 |
| TMC1 | 1865 | 2256491 | C | RECESSIVE | 0.008288 | 0.58 |
| TMC1 | 1866 | 2589609 | T | RECESSIVE | 0.006119 | 0.57 |
| TMC1 | 1867 | 7860172 | A | RECESSIVE | 0.014842 | 2.04 |
| TMC1 | 1868 | 12000987 | T | DOMINANT | 0.045381 | 0.78 |
| GNAQ | 1874 | 10869954 | A | DOMINANT | 0.015380 | 1.21 |
| GNAQ | 1875 | 10869955 | A | RECESSIVE | 0.003435 | 0.79 |
| GNAQ | 1876 | 12551478 | C | DOMINANT | 0.014351 | 1.19 |
| GNAQ | 1877 | 6560612 | T | DOMINANT | 0.041744 | 1.15 |
| GNAQ | 1878 | 10869960 | T | DOMINANT | 0.047659 | 1.15 |
| GNAQ | 1882 | 10781482 | T | RECESSIVE | 0.042270 | 1.41 |
| SHC3 | 1902 | 1125467 | C | ADDITIVE | 0.033919 | 1.15 |
| SHC3 | 1903 | 9410299 | C | ADDITIVE | 0.007328 | 0.86 |
| SHC3 | 1904 | 7868553 | T | RECESSIVE | 0.046564 | 1.24 |
| DIRAS2 | 1905 | 690474 | G | ADDITIVE | 0.022096 | 1.11 |
| DIRAS2 | 1907 | 7028171 | A | RECESSIVE | 0.044570 | 0.77 |
| NFIL3 | 1909 | 7038686 | A | DOMINANT | 0.016229 | 1.19 |
| GABBR2 | 1911 | 16914425 | T | ADDITIVE | 0.045254 | 1.44 |
| GRIN3A | 1915 | 9299345 | T | ADDITIVE | 0.028101 | 0.84 |
| GRIN3A | 1921 | 1853447 | T | ADDITIVE | 0.026043 | 0.87 |
| GRIN3A | 1923 | 4742823 | A | ADDITIVE | 0.028114 | 0.84 |
| GRIN3A | 1925 | 2506362 | C | ADDITIVE | 0.015761 | 0.92 |
| FKTN | 1929 | 2768290 | G | ADDITIVE | 0.031902 | 0.87 |
| FKTN | 1930 | 2768294 | G | DOMINANT | 0.046703 | 0.87 |
| FKTN | 1931 | 2518106 | A | ADDITIVE | 0.048622 | 0.87 |
| PALM2 | 1932 | 1358912 | A | ADDITIVE | 0.020090 | 1.06 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| PALM2 | 1933 | 10739282 | A | RECESSIVE | 0.025066 | 1.24 |
| PALM2 | 1934 | 4978848 | G | ADDITIVE | 0.024272 | 1.07 |
| PALM2 | 1935 | 2025878 | A | RECESSIVE | 0.036827 | 1.21 |
| PALM2 | 1936 | 4246875 | A | RECESSIVE | 0.026623 | 1.22 |
| MUSK | 1940 | 3001115 | T | ADDITIVE | 0.026372 | 1.13 |
| MUSK | 1943 | 1184926 | T | ADDITIVE | 0.042279 | 0.85 |
| DFNB31 | 1948 | 2274160 | T | RECESSIVE | 0.005390 | 1.51 |
| DFNB31 | 1949 | 731421 | T | RECESSIVE | 0.030474 | 0.71 |
| DFNB31 | 1950 | 10817607 | G | RECESSIVE | 0.025753 | 0.70 |
| DFNB31 | 1951 | 7875262 | T | RECESSIVE | 0.033082 | 0.71 |
| DFNB31 | 1952 | 10081699 | G | RECESSIVE | 0.013955 | 1.43 |
| DFNB31 | 1953 | 10739411 | G | ADDITIVE | 0.026062 | 0.92 |
| DFNB31 | 1954 | 10982213 | A | RECESSIVE | 0.020370 | 0.70 |
| DFNB31 | 1955 | 1408527 | C | RECESSIVE | 0.015767 | 1.41 |
| PAPPA | 1963 | 10759836 | T | RECESSIVE | 0.005237 | 0.72 |
| PAPPA | 1964 | 13285093 | C | DOMINANT | 0.029229 | 1.17 |
| ASTN2 | 1976 | 10759876 | A | DOMINANT | 0.003467 | 1.24 |
| ASTN2 | 1977 | 3849144 | G | DOMINANT | 0.004674 | 1.23 |
| ASTN2 | 1978 | 12350890 | A | DOMINANT | 0.013281 | 1.25 |
| ASTN2 | 1979 | 10817968 | A | ADDITIVE | 0.026212 | 1.24 |
| ASTN2 | 1983 | 1928998 | G | ADDITIVE | 0.038135 | 1.19 |
| ASTN2 | 1984 | 10983518 | C | RECESSIVE | 0.016127 | 0.68 |
| ASTN2 | 1985 | 13298697 | A | RECESSIVE | 0.047152 | 0.72 |
| RAB14 | 1992 | 2302498 | A | RECESSIVE | 0.015476 | 0.80 |
| GSN | 1993 | 12376078 | A | DOMINANT | 0.003682 | 1.47 |
| GSN | 1994 | 10985207 | G | DOMINANT | 0.005065 | 1.46 |
| GSN | 1996 | 767770 | T | DOMINANT | 0.000187 | 1.69 |
| TTLL11 | 1998 | 10818618 | C | RECESSIVE | 0.039629 | 0.73 |
| NEK6 | 2017 | 749355 | A | ADDITIVE | 0.030480 | 1.23 |
| TSC1 | 2031 | 7874234 | T | ADDITIVE | 0.011367 | 0.84 |
| VAV2 | 2032 | 10993790 | T | DOMINANT | 0.003427 | 1.26 |
| VAV2 | 2033 | 7855899 | C | RECESSIVE | 0.003355 | 1.68 |
| VAV2 | 2034 | 3780737 | T | RECESSIVE | 0.004754 | 0.47 |
| VAV2 | 2035 | 7038256 | T | RECESSIVE | 0.025434 | 0.51 |
| VAV2 | 2036 | 7025939 | C | RECESSIVE | 0.023272 | 0.49 |
| NOTCH1 | 2041 | 11145770 | T | RECESSIVE | 0.002492 | 0.74 |
| CACNA1B | 2042 | 2168526 | T | RECESSIVE | 0.024854 | 1.69 |
| CACNA1B | 2043 | 10780196 | A | RECESSIVE | 0.027471 | 1.69 |
| CACNA1B | 2044 | 7028989 | T | RECESSIVE | 0.017789 | 1.75 |
| CACNA1B | 2045 | 12005780 | C | RECESSIVE | 0.012863 | 1.84 |
| CACNB2 | 2051 | 2357928 | G | ADDITIVE | 0.012595 | 0.91 |
| CACNB2 | 2053 | 11014484 | C | DOMINANT | 0.024884 | 0.85 |
| CACNB2 | 2054 | 12416052 | C | RECESSIVE | 0.004716 | 1.31 |
| CACNB2 | 2055 | 12257556 | G | RECESSIVE | 0.002839 | 1.29 |
| CACNB2 | 2056 | 4748474 | G | RECESSIVE | 0.007791 | 1.26 |
| CACNB2 | 2057 | 4237348 | C | DOMINANT | 0.041066 | 0.85 |
| CACNB2 | 2058 | 12764916 | T | DOMINANT | 0.031006 | 0.86 |
| CACNB2 | 2059 | 4628581 | C | DOMINANT | 0.023338 | 0.84 |
| CACNB2 | 2060 | 7910506 | G | DOMINANT | 0.014403 | 1.19 |
| CACNB2 | 2062 | 10828859 | C | RECESSIVE | 0.008707 | 1.28 |
| ARMC3 | 2063 | 10828371 | T | RECESSIVE | 0.021711 | 1.49 |
| ARMC3 | 2064 | 17440393 | A | RECESSIVE | 0.006511 | 1.67 |
| ARMC3 | 2065 | 7084413 | C | RECESSIVE | 0.018948 | 1.40 |
| MYO3A | 2068 | 1339814 | T | RECESSIVE | 0.022947 | 1.28 |
| MYO3A | 2069 | 1416860 | T | RECESSIVE | 0.025959 | 1.28 |
| MYO3A | 2070 | 7899567 | A | RECESSIVE | 0.029350 | 1.27 |
| MYO3A | 2071 | 11014934 | G | RECESSIVE | 0.017798 | 1.30 |
| MYO3A | 2072 | 12246202 | C | RECESSIVE | 0.042753 | 1.27 |
| MYO3A | 2073 | 12263990 | G | RECESSIVE | 0.046502 | 1.25 |
| MYO3A | 2074 | 7095559 | A | RECESSIVE | 0.024761 | 1.28 |
| MYO3A | 2075 | 12258453 | T | RECESSIVE | 0.026415 | 1.28 |
| PRKG1 | 2078 | 6479874 | T | RECESSIVE | 0.014762 | 1.91 |
| PRKG1 | 2084 | 293244 | A | ADDITIVE | 0.020720 | 1.21 |
| PCDH15 | 2090 | 2610922 | A | RECESSIVE | 0.018308 | 3.44 |
| PCDH15 | 2092 | 4465289 | C | RECESSIVE | 0.017216 | 1.69 |
| PCDH15 | 2093 | 1020203 | G | DOMINANT | 0.003999 | 0.79 |
| PCDH15 | 2094 | 2384413 | T | DOMINANT | 0.003476 | 0.79 |
| PCDH15 | 2095 | 7477283 | T | DOMINANT | 0.005120 | 0.80 |
| PCDH15 | 2096 | 10740578 | C | DOMINANT | 0.001890 | 0.78 |
| PCDH15 | 2097 | 7919293 | G | DOMINANT | 0.006251 | 0.80 |
| PCDH15 | 2098 | 2384419 | G | DOMINANT | 0.004336 | 0.79 |
| PCDH15 | 2099 | 2891506 | T | DOMINANT | 0.003985 | 0.79 |
| PCDH15 | 2100 | 997066 | A | DOMINANT | 0.015385 | 0.84 |
| PCDH15 | 2101 | 857374 | C | DOMINANT | 0.022635 | 0.85 |
| PCDH15 | 2102 | 1342281 | T | DOMINANT | 0.018736 | 0.85 |
| PCDH15 | 2103 | 857395 | C | DOMINANT | 0.017903 | 0.85 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| PCDH15 | 2104 | 11004267 | A | DOMINANT | 0.009219 | 0.83 |
| PCDH15 | 2105 | 11004270 | T | DOMINANT | 0.029388 | 0.86 |
| PCDH15 | 2106 | 7069188 | C | RECESSIVE | 0.014258 | 1.46 |
| PCDH15 | 2108 | 7474541 | C | RECESSIVE | 0.016106 | 1.51 |
| PCDH15 | 2109 | 3902590 | G | RECESSIVE | 0.012226 | 1.54 |
| ANK3 | 2115 | 7907721 | A | RECESSIVE | 0.033308 | 0.79 |
| ANK3 | 2116 | 4948254 | A | RECESSIVE | 0.023395 | 1.27 |
| JMJD1C | 2124 | 10995505 | A | RECESSIVE | 0.026757 | 1.44 |
| JMJD1C | 2126 | 10761747 | G | RECESSIVE | 0.016333 | 1.50 |
| CTNNA3 | 2128 | 10509256 | A | RECESSIVE | 0.041901 | 0.68 |
| CTNNA3 | 2129 | 3911783 | A | ADDITIVE | 0.040526 | 1.09 |
| CTNNA3 | 2140 | 7893145 | C | DOMINANT | 0.000786 | 0.79 |
| CTNNA3 | 2141 | 7922094 | C | DOMINANT | 0.007206 | 1.21 |
| CTNNA3 | 2142 | 7907580 | T | DOMINANT | 0.008743 | 1.21 |
| CTNNA3 | 2143 | 10997420 | C | RECESSIVE | 0.014850 | 1.23 |
| CTNNA3 | 2144 | 1925605 | T | RECESSIVE | 0.049015 | 1.19 |
| CTNNA3 | 2154 | 2448547 | G | DOMINANT | 0.022824 | 0.75 |
| CTNNA3 | 2155 | 2616687 | G | DOMINANT | 0.011127 | 0.79 |
| KCNMA1 | 2165 | 2569360 | C | RECESSIVE | 0.027821 | 1.22 |
| KCNMA1 | 2166 | 2569361 | C | RECESSIVE | 0.021437 | 1.23 |
| KCNMA1 | 2167 | 4980107 | C | RECESSIVE | 0.041453 | 1.20 |
| KCNMA1 | 2168 | 10762731 | G | RECESSIVE | 0.024986 | 1.22 |
| KCNMA1 | 2169 | 4980113 | C | RECESSIVE | 0.032402 | 1.21 |
| KCNMA1 | 2170 | 10762732 | T | RECESSIVE | 0.034144 | 1.20 |
| KCNMA1 | 2173 | 3781158 | T | DOMINANT | 0.019022 | 0.85 |
| KCNMA1 | 2174 | 2131216 | T | DOMINANT | 0.019030 | 0.84 |
| KCNMA1 | 2175 | 10509378 | A | DOMINANT | 0.007199 | 0.83 |
| KCNMA1 | 2176 | 12219498 | T | DOMINANT | 0.015542 | 0.84 |
| NRG3 | 2184 | 1124744 | A | DOMINANT | 0.002015 | 1.29 |
| NRG3 | 2186 | 11595839 | G | ADDITIVE | 0.025402 | 1.27 |
| NRG3 | 2187 | 474496 | G | DOMINANT | 0.005874 | 1.21 |
| NRG3 | 2188 | 495978 | A | DOMINANT | 0.006781 | 1.21 |
| SORBS1 | 2190 | 11188287 | G | RECESSIVE | 0.021191 | 1.53 |
| SORBS1 | 2193 | 7080545 | C | ADDITIVE | 0.043587 | 0.86 |
| SORBS1 | 2194 | 11188327 | C | DOMINANT | 0.007510 | 1.21 |
| PIK3AP1 | 2196 | 7448 | G | RECESSIVE | 0.005100 | 1.37 |
| PIK3AP1 | 2197 | 1983831 | A | RECESSIVE | 0.006490 | 1.34 |
| PIK3AP1 | 2198 | 912480 | G | RECESSIVE | 0.002642 | 1.44 |
| PIK3AP1 | 2199 | 7914154 | C | RECESSIVE | 0.010974 | 1.33 |
| SLIT1 | 2201 | 2817688 | G | DOMINANT | 0.007821 | 1.21 |
| SLIT1 | 2202 | 2636815 | A | DOMINANT | 0.006388 | 1.23 |
| SLIT1 | 2203 | 2817666 | A | DOMINANT | 0.004951 | 0.81 |
| SORCS3 | 2209 | 1387827 | A | ADDITIVE | 0.021458 | 1.03 |
| SORCS3 | 2210 | 973190 | T | ADDITIVE | 0.016671 | 1.09 |
| SORCS3 | 2211 | 2496029 | A | ADDITIVE | 0.021204 | 1.09 |
| SORCS3 | 2213 | 2451492 | T | DOMINANT | 0.049209 | 0.87 |
| SORCS3 | 2214 | 2451498 | C | DOMINANT | 0.041030 | 0.86 |
| SORCS3 | 2215 | 2177744 | C | DOMINANT | 0.022268 | 1.18 |
| SORCS3 | 2217 | 7072425 | A | DOMINANT | 0.037455 | 1.22 |
| VTI1A | 2218 | 10509963 | A | RECESSIVE | 0.045868 | 0.78 |
| ATRNL1 | 2220 | 1264764 | C | ADDITIVE | 0.024878 | 0.87 |
| ATRNL1 | 2223 | 12767028 | C | DOMINANT | 0.017014 | 1.20 |
| ATRNL1 | 2224 | 7922670 | G | DOMINANT | 0.022609 | 1.19 |
| ATRNL1 | 2225 | 11197255 | G | DOMINANT | 0.019749 | 1.20 |
| ATRNL1 | 2228 | 11197294 | T | DOMINANT | 0.027662 | 1.19 |
| ATRNL1 | 2230 | 2804192 | A | ADDITIVE | 0.029904 | 1.14 |
| ATRNL1 | 2231 | 7095798 | T | DOMINANT | 0.034822 | 1.18 |
| ATRNL1 | 2232 | 2804204 | T | ADDITIVE | 0.031879 | 1.15 |
| ATRNL1 | 2233 | 2804207 | C | ADDITIVE | 0.032750 | 0.90 |
| ATRNL1 | 2234 | 1590734 | G | ADDITIVE | 0.026976 | 1.17 |
| ATRNL1 | 2235 | 1590733 | G | ADDITIVE | 0.025347 | 1.18 |
| ATRNL1 | 2236 | 10787584 | T | ADDITIVE | 0.008453 | 1.20 |
| ATRNL1 | 2237 | 11197337 | T | ADDITIVE | 0.027025 | 1.18 |
| ATRNL1 | 2238 | 2804249 | G | ADDITIVE | 0.026115 | 0.91 |
| ATRNL1 | 2239 | 2420098 | G | ADDITIVE | 0.029450 | 0.90 |
| HSPA12A | 2241 | 12777585 | G | RECESSIVE | 0.015733 | 1.38 |
| NANOS1 | 2244 | 9325559 | T | ADDITIVE | 0.019015 | 0.88 |
| ATE1 | 2251 | 7086628 | G | ADDITIVE | 0.038812 | 0.92 |
| ATE1 | 2252 | 1693682 | A | RECESSIVE | 0.028622 | 0.82 |
| ATE1 | 2256 | 10510102 | G | RECESSIVE | 0.020025 | 1.61 |
| EBF3 | 2265 | 10829666 | A | ADDITIVE | 0.008326 | 0.83 |
| CEND1 | 2269 | 11246327 | T | DOMINANT | 0.016652 | 0.82 |
| HCCA2 | 2270 | 11029977 | T | ADDITIVE | 0.026816 | 1.12 |
| HCCA2 | 2271 | 1554855 | C | ADDITIVE | 0.006336 | 1.15 |
| HCCA2 | 2272 | 4881740 | T | ADDITIVE | 0.003597 | 1.17 |
| HCCA2 | 2273 | 7396009 | T | ADDITIVE | 0.002743 | 1.18 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| DUSP8 | 2274 | 1108991 | G | ADDITIVE | 0.002643 | 1.18 |
| DUSP8 | 2275 | 6578475 | C | ADDITIVE | 0.000799 | 1.29 |
| DUSP8 | 2276 | 6578476 | G | ADDITIVE | 0.003429 | 1.15 |
| DUSP8 | 2277 | 10734456 | C | DOMINANT | 0.026547 | 1.17 |
| STIM1 | 2278 | 7924984 | A | DOMINANT | 0.024698 | 1.17 |
| TRIM21 | 2279 | 10835979 | G | ADDITIVE | 0.009525 | 1.32 |
| GALNTL4 | 2281 | 7120631 | T | ADDITIVE | 0.032773 | 0.94 |
| GALNTL4 | 2283 | 901553 | C | RECESSIVE | 0.047890 | 1.23 |
| MICAL2 | 2287 | 11022241 | A | RECESSIVE | 0.045635 | 1.20 |
| MICAL2 | 2288 | 10437600 | A | RECESSIVE | 0.011587 | 0.62 |
| MICAL2 | 2290 | 12807026 | C | ADDITIVE | 0.013182 | 0.86 |
| SPON1 | 2291 | 2697852 | G | DOMINANT | 0.049783 | 0.87 |
| SPON1 | 2292 | 1969542 | C | DOMINANT | 0.007499 | 0.83 |
| SPON1 | 2293 | 7116230 | A | ADDITIVE | 0.020903 | 0.88 |
| SPON1 | 2294 | 11023051 | C | DOMINANT | 0.031882 | 0.85 |
| SPON1 | 2295 | 1528668 | C | ADDITIVE | 0.032120 | 0.89 |
| SPON1 | 2296 | 11601500 | C | ADDITIVE | 0.024398 | 0.88 |
| SPON1 | 2297 | 10832163 | T | ADDITIVE | 0.018945 | 0.88 |
| SPON1 | 2298 | 11023054 | A | ADDITIVE | 0.023861 | 0.88 |
| SPON1 | 2299 | 10832165 | A | ADDITIVE | 0.025929 | 0.89 |
| SPON1 | 2300 | 11023055 | G | ADDITIVE | 0.024619 | 0.89 |
| SPON1 | 2301 | 7112850 | A | ADDITIVE | 0.009613 | 0.86 |
| SPON1 | 2302 | 10766134 | G | ADDITIVE | 0.018251 | 0.92 |
| SPON1 | 2303 | 12283632 | A | DOMINANT | 0.024620 | 0.85 |
| SPON1 | 2304 | 11023067 | G | DOMINANT | 0.013934 | 0.84 |
| SPON1 | 2305 | 882667 | G | DOMINANT | 0.010949 | 1.22 |
| SPON1 | 2306 | 1528641 | A | DOMINANT | 0.014322 | 1.21 |
| SPON1 | 2307 | 7116296 | T | DOMINANT | 0.027466 | 1.19 |
| SPON1 | 2308 | 11023088 | T | DOMINANT | 0.025094 | 1.19 |
| SPON1 | 2309 | 1864658 | C | DOMINANT | 0.047272 | 0.87 |
| SPON1 | 2310 | 4757244 | A | DOMINANT | 0.049295 | 0.87 |
| SPON1 | 2313 | 4756787 | C | RECESSIVE | 0.010483 | 0.45 |
| USH1C | 2314 | 4756895 | T | RECESSIVE | 0.030914 | 1.22 |
| USH1C | 2315 | 1055581 | G | DOMINANT | 0.002232 | 0.78 |
| USH1C | 2316 | 2072230 | T | RECESSIVE | 0.002686 | 1.34 |
| USH1C | 2317 | 16934376 | C | RECESSIVE | 0.044775 | 0.23 |
| OTOG | 2318 | 10832822 | A | ADDITIVE | 0.011682 | 0.80 |
| PTPN5 | 2329 | 4757718 | G | ADDITIVE | 0.030868 | 1.13 |
| NAV2 | 2330 | 10500860 | C | ADDITIVE | 0.005524 | 1.18 |
| NAV2 | 2331 | 1559665 | G | RECESSIVE | 0.026395 | 1.20 |
| NAV2 | 2332 | 1559666 | C | ADDITIVE | 0.023490 | 1.09 |
| NAV2 | 2334 | 4757841 | G | ADDITIVE | 0.019763 | 0.92 |
| NAV2 | 2335 | 10766590 | A | ADDITIVE | 0.020748 | 1.06 |
| NAV2 | 2336 | 10734284 | T | ADDITIVE | 0.012674 | 1.10 |
| NAV2 | 2337 | 10741800 | C | ADDITIVE | 0.021872 | 1.08 |
| NAV2 | 2338 | 11025246 | C | RECESSIVE | 0.007488 | 1.31 |
| NAV2 | 2340 | 2255677 | A | DOMINANT | 0.019534 | 1.19 |
| NAV2 | 2341 | 10732471 | T | ADDITIVE | 0.023843 | 0.89 |
| NAV2 | 2342 | 1470254 | T | ADDITIVE | 0.039435 | 0.89 |
| NAV2 | 2343 | 1470253 | C | ADDITIVE | 0.041924 | 0.88 |
| NAV2 | 2344 | 1470251 | A | ADDITIVE | 0.025843 | 0.86 |
| SLC6A5 | 2345 | 1443548 | T | DOMINANT | 0.024295 | 1.18 |
| SLC6A5 | 2346 | 4922798 | G | RECESSIVE | 0.011680 | 1.37 |
| SLC6A5 | 2347 | 10766703 | A | RECESSIVE | 0.011211 | 1.37 |
| SLC6A5 | 2348 | 10741848 | T | RECESSIVE | 0.038041 | 1.21 |
| SLC6A5 | 2349 | 10741849 | G | RECESSIVE | 0.043513 | 1.20 |
| SLC6A5 | 2350 | 4454712 | T | RECESSIVE | 0.004974 | 1.32 |
| SLC6A5 | 2351 | 2276431 | A | RECESSIVE | 0.009040 | 1.32 |
| KCNA4 | 2353 | 11030913 | C | DOMINANT | 0.023874 | 0.84 |
| KCNA4 | 2354 | 524373 | G | ADDITIVE | 0.009368 | 1.26 |
| KCNA4 | 2355 | 10835607 | A | DOMINANT | 0.021842 | 0.84 |
| KCNA4 | 2356 | 536830 | C | ADDITIVE | 0.010851 | 1.23 |
| LRRC4C | 2357 | 2953310 | C | ADDITIVE | 0.036554 | 1.09 |
| LRRC4C | 2358 | 7943560 | G | ADDITIVE | 0.012296 | 1.17 |
| LRRC4C | 2359 | 10160235 | T | RECESSIVE | 0.040393 | 1.26 |
| LRRC4C | 2360 | 4237677 | C | DOMINANT | 0.031520 | 1.17 |
| LRRC4C | 2361 | 4237678 | G | DOMINANT | 0.000965 | 1.29 |
| LRRC4C | 2372 | 1377106 | T | DOMINANT | 0.042343 | 0.83 |
| LRRC4C | 2375 | 10837391 | G | ADDITIVE | 0.009622 | 1.14 |
| PHACS | 2379 | 7950395 | T | DOMINANT | 0.038936 | 1.19 |
| PHACS | 2380 | 113080 | G | ADDITIVE | 0.011000 | 0.89 |
| PHACS | 2381 | 2285029 | A | ADDITIVE | 0.012050 | 0.88 |
| CTNND1 | 2390 | 576859 | A | RECESSIVE | 0.018240 | 0.75 |
| CTNND1 | 2391 | 2956981 | A | DOMINANT | 0.045557 | 1.16 |
| DLG2 | 2398 | 10501540 | G | RECESSIVE | 0.047974 | 0.83 |
| DLG2 | 2399 | 11233641 | G | RECESSIVE | 0.038672 | 0.81 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| DLG2 | 2400 | 7116939 | C | RECESSIVE | 0.049426 | 0.80 |
| DLG2 | 2405 | 635823 | G | RECESSIVE | 0.039970 | 0.81 |
| DLG2 | 2420 | 10898330 | C | DOMINANT | 0.019595 | 1.20 |
| OPCML | 2422 | 1823365 | T | DOMINANT | 0.000367 | 0.72 |
| OPCML | 2423 | 2277271 | C | DOMINANT | 0.028391 | 1.17 |
| OPCML | 2428 | 4554901 | T | RECESSIVE | 0.021988 | 0.55 |
| OPCML | 2429 | 7945576 | T | ADDITIVE | 0.041086 | 1.05 |
| WNT5B | 2430 | 10773971 | G | ADDITIVE | 0.013765 | 1.63 |
| WNT5B | 2431 | 4766401 | T | RECESSIVE | 0.016081 | 1.41 |
| TSPAN9 | 2432 | 1860431 | T | ADDITIVE | 0.044410 | 1.23 |
| TSPAN9 | 2433 | 7969363 | T | DOMINANT | 0.003161 | 1.23 |
| TMEM16B | 2437 | 10849338 | G | ADDITIVE | 0.049314 | 0.86 |
| TMEM16B | 2438 | 3782652 | G | DOMINANT | 0.023546 | 1.20 |
| TMEM16B | 2441 | 11832095 | A | DOMINANT | 0.006913 | 1.21 |
| TMEM16B | 2442 | 11063875 | T | DOMINANT | 0.008667 | 1.21 |
| STYK1 | 2443 | 10845187 | C | RECESSIVE | 0.027359 | 1.23 |
| STYK1 | 2444 | 6488316 | T | RECESSIVE | 0.048914 | 1.20 |
| STYK1 | 2445 | 2418087 | C | RECESSIVE | 0.038431 | 1.21 |
| STYK1 | 2446 | 2418088 | G | RECESSIVE | 0.045827 | 1.20 |
| STYK1 | 2447 | 7350597 | A | RECESSIVE | 0.044659 | 1.20 |
| STYK1 | 2448 | 10743918 | C | DOMINANT | 0.010106 | 0.83 |
| LOC729025 | 2449 | 7955194 | T | DOMINANT | 0.015742 | 0.83 |
| LOC729025 | 2450 | 10219493 | G | DOMINANT | 0.030417 | 0.84 |
| LOC729025 | 2451 | 3847918 | G | DOMINANT | 0.020876 | 0.83 |
| LOC729025 | 2452 | 7297251 | C | DOMINANT | 0.030287 | 0.84 |
| LOC729025 | 2453 | 7297372 | G | DOMINANT | 0.005504 | 0.81 |
| LOC729025 | 2454 | 10772915 | A | DOMINANT | 0.003516 | 0.80 |
| LOC729025 | 2455 | 1913253 | T | DOMINANT | 0.023973 | 0.83 |
| LOC729025 | 2456 | 1799491 | T | DOMINANT | 0.003693 | 0.80 |
| LOC729025 | 2457 | 3915237 | C | DOMINANT | 0.032814 | 0.86 |
| PIK3C2G | 2458 | 4491292 | T | DOMINANT | 0.026816 | 1.17 |
| PIK3C2G | 2459 | 10841014 | A | ADDITIVE | 0.003107 | 1.16 |
| PIK3C2G | 2460 | 9300118 | G | ADDITIVE | 0.009854 | 1.17 |
| PIK3C2G | 2463 | 11044130 | A | ADDITIVE | 0.043648 | 0.81 |
| ITPR2 | 2465 | 11048447 | T | DOMINANT | 0.036036 | 0.86 |
| ITPR2 | 2466 | 9442 | T | DOMINANT | 0.011697 | 0.83 |
| ITPR2 | 2467 | 2570 | C | DOMINANT | 0.014971 | 0.84 |
| ITPR2 | 2469 | 11048588 | G | ADDITIVE | 0.002640 | 0.91 |
| ITPR2 | 2470 | 2230377 | T | ADDITIVE | 0.003187 | 0.89 |
| ITPR2 | 2471 | 6487566 | A | DOMINANT | 0.013025 | 0.84 |
| LRP1 | 2472 | 7975818 | C | RECESSIVE | 0.014070 | 0.75 |
| LRP1 | 2473 | 1800176 | T | RECESSIVE | 0.019701 | 0.76 |
| LRP1 | 2474 | 1800168 | C | RECESSIVE | 0.019762 | 0.76 |
| LRP1 | 2475 | 7301155 | G | RECESSIVE | 0.019893 | 0.77 |
| CNOT2 | 2477 | 7974636 | T | DOMINANT | 0.016534 | 0.84 |
| KCNC2 | 2478 | 4309217 | A | RECESSIVE | 0.014095 | 0.75 |
| KCNC2 | 2479 | 4131954 | T | RECESSIVE | 0.012375 | 0.74 |
| CHST11 | 2487 | 11112146 | T | ADDITIVE | 0.037414 | 1.10 |
| CHST11 | 2488 | 2453161 | G | DOMINANT | 0.005432 | 0.82 |
| CHST11 | 2489 | 2468110 | A | DOMINANT | 0.004451 | 0.82 |
| CHST11 | 2490 | 2642109 | T | DOMINANT | 0.010529 | 0.83 |
| CHST11 | 2491 | 1565815 | T | DOMINANT | 0.034071 | 0.86 |
| CHST11 | 2492 | 1038968 | C | DOMINANT | 0.025751 | 0.85 |
| CHST11 | 2493 | 2696006 | T | DOMINANT | 0.021717 | 0.85 |
| CHST11 | 2494 | 2463017 | C | DOMINANT | 0.022342 | 0.85 |
| CHST11 | 2495 | 2468082 | G | DOMINANT | 0.021225 | 0.85 |
| CHST11 | 2496 | 2468083 | A | DOMINANT | 0.015754 | 0.84 |
| KIAA1853 | 2497 | 7134748 | G | RECESSIVE | 0.047235 | 1.28 |
| RIMBP2 | 2504 | 7132917 | A | ADDITIVE | 0.040625 | 0.73 |
| RIMBP2 | 2505 | 1982939 | T | ADDITIVE | 0.039930 | 0.80 |
| MTIF3 | 2515 | 7334690 | A | ADDITIVE | 0.031553 | 0.89 |
| N4BP2L2 | 2518 | 1081796 | A | RECESSIVE | 0.030849 | 1.48 |
| NBEA | 2524 | 9600580 | A | RECESSIVE | 0.035462 | 1.81 |
| KPNA3 | 2533 | 7997798 | A | ADDITIVE | 0.045890 | 0.84 |
| KPNA3 | 2534 | 4942864 | G | ADDITIVE | 0.039912 | 0.84 |
| KPNA3 | 2535 | 9535347 | G | ADDITIVE | 0.023264 | 0.86 |
| PCDH17 | 2537 | 4564470 | G | ADDITIVE | 0.003916 | 1.24 |
| SLAIN1 | 2553 | 1146920 | C | DOMINANT | 0.016112 | 1.19 |
| NALCN | 2590 | 7321815 | A | RECESSIVE | 0.000016 | 1.56 |
| NALCN | 2591 | 3751403 | T | RECESSIVE | 0.000016 | 1.61 |
| NALCN | 2592 | 12430088 | T | RECESSIVE | 0.000020 | 1.59 |
| NALCN | 2593 | 638732 | C | RECESSIVE | 0.000202 | 1.48 |
| NALCN | 2594 | 2274085 | T | RECESSIVE | 0.002256 | 1.30 |
| NALCN | 2595 | 7334863 | C | RECESSIVE | 0.000134 | 1.44 |
| NALCN | 2596 | 1289556 | G | ADDITIVE | 0.010143 | 0.89 |
| NALCN | 2597 | 9554752 | T | RECESSIVE | 0.000046 | 1.51 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| NALCN | 2598 | 633321 | G | ADDITIVE | 0.024253 | 0.91 |
| NALCN | 2599 | 2044118 | A | RECESSIVE | 0.000020 | 1.58 |
| NALCN | 2600 | 7986657 | G | RECESSIVE | 0.000381 | 1.50 |
| ITGBL1 | 2603 | 1335589 | T | RECESSIVE | 0.018609 | 1.37 |
| ITGBL1 | 2604 | 875117 | G | RECESSIVE | 0.023042 | 1.36 |
| ITGBL1 | 2605 | 875116 | C | RECESSIVE | 0.021721 | 1.36 |
| ITGBL1 | 2606 | 3783222 | G | RECESSIVE | 0.006719 | 1.33 |
| ITGBL1 | 2608 | 17686597 | C | DOMINANT | 0.027308 | 1.20 |
| ITGBL1 | 2609 | 2281991 | G | DOMINANT | 0.020401 | 1.21 |
| ITGBL1 | 2610 | 1469855 | G | DOMINANT | 0.021955 | 1.20 |
| ITGBL1 | 2611 | 1469853 | G | DOMINANT | 0.028859 | 1.19 |
| TTC5 | 2615 | 10139180 | A | ADDITIVE | 0.013975 | 0.90 |
| WDR23 | 2627 | 6573565 | A | RECESSIVE | 0.015197 | 1.32 |
| NOVA1 | 2628 | 6574950 | C | RECESSIVE | 0.044675 | >5 |
| NOVA1 | 2629 | 178165 | C | RECESSIVE | 0.037814 | 1.28 |
| SLC25A21 | 2631 | 17105036 | T | DOMINANT | 0.001136 | 0.63 |
| SLC25A21 | 2632 | 712342 | C | ADDITIVE | 0.020794 | 0.88 |
| SLC25A21 | 2635 | 1950367 | C | ADDITIVE | 0.014648 | 0.61 |
| GNG2 | 2636 | 7158738 | C | RECESSIVE | 0.039010 | 0.84 |
| GNG2 | 2637 | 4278650 | C | ADDITIVE | 0.025528 | 1.18 |
| GNG2 | 2638 | 7148347 | G | ADDITIVE | 0.025573 | 1.16 |
| GNG2 | 2639 | 12878420 | T | RECESSIVE | 0.038410 | 0.83 |
| GNG2 | 2640 | 10131301 | T | RECESSIVE | 0.015036 | 0.80 |
| GNG2 | 2641 | 1959518 | C | DOMINANT | 0.030573 | 1.18 |
| GNG2 | 2642 | 1959517 | A | DOMINANT | 0.031171 | 1.18 |
| GNG2 | 2647 | 10873056 | C | ADDITIVE | 0.025723 | 1.43 |
| SAMD4A | 2648 | 4901520 | A | DOMINANT | 0.006420 | 1.25 |
| SAMD4A | 2649 | 6572964 | A | RECESSIVE | 0.004562 | 0.60 |
| SAMD4A | 2650 | 3813402 | A | DOMINANT | 0.012538 | 1.20 |
| DAAM1 | 2654 | 1272858 | G | ADDITIVE | 0.012202 | 0.91 |
| DAAM1 | 2655 | 2295850 | C | ADDITIVE | 0.031869 | 0.91 |
| GPR135 | 2656 | 1253165 | A | ADDITIVE | 0.048407 | 0.91 |
| GPR135 | 2657 | 11628147 | A | ADDITIVE | 0.006366 | 0.90 |
| GPR135 | 2658 | 1271183 | T | ADDITIVE | 0.007668 | 0.90 |
| GPR135 | 2659 | 1253170 | T | RECESSIVE | 0.039459 | 0.80 |
| GPR135 | 2660 | 10136708 | G | ADDITIVE | 0.018228 | 0.89 |
| PPP2R5E | 2661 | 6573507 | C | RECESSIVE | 0.036369 | 0.74 |
| PPP2R5E | 2662 | 6573508 | C | RECESSIVE | 0.037725 | 0.74 |
| PPP2R5E | 2663 | 6573522 | A | DOMINANT | 0.017188 | 1.18 |
| PPP2R5E | 2664 | 2754223 | G | DOMINANT | 0.014128 | 1.19 |
| PPP2R5E | 2665 | 10129182 | T | ADDITIVE | 0.003108 | 1.21 |
| PPP2R5E | 2666 | 964954 | G | DOMINANT | 0.011911 | 1.19 |
| PPP2R5E | 2667 | 1255771 | G | DOMINANT | 0.004338 | 1.23 |
| PPP2R5E | 2668 | 8021183 | G | ADDITIVE | 0.002841 | 1.21 |
| PPP2R5E | 2669 | 1255741 | A | DOMINANT | 0.024639 | 1.17 |
| RGS6 | 2685 | 2526896 | C | RECESSIVE | 0.023660 | 0.82 |
| KCNK10 | 2686 | 12587003 | C | RECESSIVE | 0.002115 | 1.45 |
| KCNK10 | 2687 | 11627082 | A | RECESSIVE | 0.000848 | 1.72 |
| RPS6KA5 | 2698 | 1286146 | G | DOMINANT | 0.005154 | 1.22 |
| CCDC88C | 2700 | 1970912 | T | DOMINANT | 0.012282 | 1.17 |
| CCDC88C | 2708 | 2295882 | C | ADDITIVE | 0.035938 | 0.81 |
| ATXN3 | 2710 | 8008215 | G | ADDITIVE | 0.016375 | 0.83 |
| RYR3 | 2718 | 2596229 | A | DOMINANT | 0.022549 | 0.83 |
| RYR3 | 2719 | 1560968 | G | DOMINANT | 0.016056 | 0.83 |
| RYR3 | 2720 | 2676085 | A | DOMINANT | 0.006326 | 0.82 |
| RYR3 | 2721 | 2676087 | A | DOMINANT | 0.021488 | 0.83 |
| RYR3 | 2722 | 2164249 | C | RECESSIVE | 0.030824 | 0.83 |
| RYR3 | 2723 | 2596159 | T | DOMINANT | 0.018069 | 0.83 |
| RYR3 | 2724 | 2596163 | G | DOMINANT | 0.029746 | 0.85 |
| RYR3 | 2725 | 2572189 | T | RECESSIVE | 0.006751 | 0.79 |
| RYR3 | 2726 | 2082753 | A | RECESSIVE | 0.003879 | 0.77 |
| RYR3 | 2727 | 2572175 | A | RECESSIVE | 0.003637 | 0.78 |
| RYR3 | 2728 | 2572169 | A | RECESSIVE | 0.000866 | 0.74 |
| RYR3 | 2729 | 2596175 | A | RECESSIVE | 0.005002 | 0.78 |
| RYR3 | 2730 | 744776 | C | ADDITIVE | 0.029493 | 0.70 |
| RYR3 | 2732 | 1390159 | T | RECESSIVE | 0.027798 | >5 |
| RYR3 | 2734 | 7163140 | T | DOMINANT | 0.002105 | 1.26 |
| C15ORF41 | 2736 | 1901721 | C | DOMINANT | 0.004128 | 0.75 |
| C15ORF41 | 2737 | 10518905 | C | DOMINANT | 0.004549 | 0.76 |
| C15ORF41 | 2738 | 8033760 | A | DOMINANT | 0.003999 | 0.75 |
| C15ORF41 | 2739 | 16964046 | T | DOMINANT | 0.014211 | 0.78 |
| C15ORF41 | 2740 | 16964049 | A | DOMINANT | 0.005453 | 0.76 |
| C15ORF41 | 2741 | 16964052 | G | DOMINANT | 0.006294 | 0.76 |
| MEIS2 | 2742 | 16964229 | C | DOMINANT | 0.020710 | 0.82 |
| MEIS2 | 2743 | 12900044 | T | ADDITIVE | 0.013848 | 1.12 |
| MEIS2 | 2744 | 11638361 | C | ADDITIVE | 0.021406 | 1.11 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| MEIS2 | 2745 | 12438771 | T | RECESSIVE | 0.007917 | 1.24 |
| KIAA1370 | 2747 | 1693523 | C | RECESSIVE | 0.021736 | 1.44 |
| KIAA1370 | 2748 | 11853179 | T | RECESSIVE | 0.008002 | 1.81 |
| UNC13C | 2750 | 2115825 | A | RECESSIVE | 0.045016 | 1.19 |
| UNC13C | 2754 | 11636356 | T | DOMINANT | 0.043811 | 1.17 |
| UNC13C | 2755 | 934192 | A | DOMINANT | 0.012088 | 1.22 |
| UNC13C | 2756 | 1897069 | G | RECESSIVE | 0.001261 | 0.76 |
| UNC13C | 2757 | 12439401 | T | RECESSIVE | 0.001191 | 0.76 |
| UNC13C | 2758 | 12900128 | C | ADDITIVE | 0.001591 | 1.25 |
| UNC13C | 2759 | 4517736 | T | RECESSIVE | 0.022153 | 1.25 |
| UNC13C | 2760 | 12908083 | T | RECESSIVE | 0.030215 | 1.23 |
| UNC13C | 2761 | 7172577 | A | RECESSIVE | 0.023330 | 1.25 |
| UNC13C | 2762 | 4776220 | T | RECESSIVE | 0.026425 | 1.24 |
| UNC13C | 2763 | 4776222 | C | RECESSIVE | 0.019881 | 1.24 |
| UNC13C | 2764 | 573320 | A | RECESSIVE | 0.019152 | 1.48 |
| UNC13C | 2765 | 8040774 | T | RECESSIVE | 0.031914 | 1.22 |
| UNC13C | 2766 | 12592914 | T | DOMINANT | 0.042845 | 0.87 |
| NEDD4 | 2768 | 10518828 | A | RECESSIVE | 0.005630 | 0.35 |
| CGNL1 | 2769 | 1039979 | T | ADDITIVE | 0.048156 | 1.07 |
| CGNL1 | 2770 | 1706376 | C | ADDITIVE | 0.048780 | 1.07 |
| GRINL1A | 2775 | 16977629 | T | ADDITIVE | 0.023972 | 0.79 |
| ADAM10 | 2777 | 1427282 | T | ADDITIVE | 0.026787 | 1.05 |
| ADAM10 | 2778 | 972801 | C | ADDITIVE | 0.032827 | 1.08 |
| ADAM10 | 2780 | 514049 | A | RECESSIVE | 0.029312 | 1.23 |
| TBC1D2B | 2782 | 4591100 | C | DOMINANT | 0.020383 | 1.18 |
| TBC1D2B | 2783 | 16969397 | T | RECESSIVE | 0.012908 | 0.18 |
| ARNT2 | 2785 | 4238521 | A | RECESSIVE | 0.000302 | 0.38 |
| ARNT2 | 2788 | 11072927 | T | ADDITIVE | 0.044369 | 0.97 |
| AKAP13 | 2796 | 7180923 | A | RECESSIVE | 0.039654 | 0.83 |
| AKAP13 | 2797 | 2880765 | A | RECESSIVE | 0.032081 | 0.83 |
| AKAP13 | 2798 | 4842888 | T | RECESSIVE | 0.031967 | 0.83 |
| AKAP13 | 2799 | 3743321 | A | RECESSIVE | 0.026612 | 0.82 |
| AKAP13 | 2800 | 8026938 | T | RECESSIVE | 0.022401 | 0.82 |
| AKAP13 | 2801 | 6496055 | A | RECESSIVE | 0.020444 | 0.82 |
| AKAP13 | 2802 | 11632326 | A | RECESSIVE | 0.007324 | 0.79 |
| AKAP13 | 2804 | 10520594 | A | RECESSIVE | 0.014430 | 1.52 |
| AKAP13 | 2805 | 17571078 | G | RECESSIVE | 0.031478 | 1.45 |
| AKAP13 | 2807 | 11631015 | G | DOMINANT | 0.025944 | 0.85 |
| AKAP13 | 2810 | 12909648 | A | RECESSIVE | 0.029193 | 1.20 |
| AKAP13 | 2811 | 7181796 | C | RECESSIVE | 0.018794 | 1.49 |
| AKAP13 | 2813 | 338535 | A | ADDITIVE | 0.021891 | 0.80 |
| SLCO3A1 | 2818 | 207970 | T | RECESSIVE | 0.019343 | 0.72 |
| SLCO3A1 | 2820 | 960440 | G | DOMINANT | 0.045442 | 1.16 |
| ST8SIA2 | 2821 | 2035645 | A | RECESSIVE | 0.006841 | 1.28 |
| RGMA | 2822 | 12438714 | T | RECESSIVE | 0.011283 | 4.32 |
| A2BP1 | 2826 | 7201725 | G | DOMINANT | 0.017247 | 1.27 |
| A2BP1 | 2827 | 12443531 | A | DOMINANT | 0.018749 | 1.28 |
| A2BP1 | 2831 | 4274456 | T | RECESSIVE | 0.045300 | 0.80 |
| A2BP1 | 2836 | 7197039 | C | ADDITIVE | 0.009536 | 1.36 |
| N4BP1 | 2839 | 9933187 | T | ADDITIVE | 0.049264 | 1.13 |
| N4BP1 | 2840 | 9937623 | T | ADDITIVE | 0.047294 | 1.12 |
| GOT2 | 2841 | 6993 | T | RECESSIVE | 0.011580 | 1.33 |
| GOT2 | 2842 | 30842 | T | RECESSIVE | 0.022879 | 1.33 |
| GOT2 | 2844 | 257637 | T | ADDITIVE | 0.036785 | 1.11 |
| GOT2 | 2847 | 185397 | T | ADDITIVE | 0.049385 | 1.12 |
| GOT2 | 2848 | 11076262 | G | RECESSIVE | 0.036619 | 1.26 |
| GOT2 | 2849 | 6499976 | A | RECESSIVE | 0.026537 | 1.32 |
| GOT2 | 2850 | 1595181 | A | RECESSIVE | 0.047739 | 1.24 |
| GOT2 | 2851 | 10852565 | C | RECESSIVE | 0.019138 | 1.34 |
| GOT2 | 2852 | 4784986 | T | RECESSIVE | 0.015787 | 1.37 |
| WWOX | 2857 | 7184271 | C | RECESSIVE | 0.030927 | 0.83 |
| MPHOSPH6 | 2864 | 2967370 | A | DOMINANT | 0.020494 | 1.18 |
| MPHOSPH6 | 2865 | 1862820 | C | DOMINANT | 0.043415 | 1.15 |
| MPHOSPH6 | 2866 | 2911391 | G | DOMINANT | 0.036535 | 1.16 |
| CDH13 | 2869 | 11149556 | G | RECESSIVE | 0.013336 | 0.79 |
| CDH13 | 2870 | 9940179 | A | DOMINANT | 0.005530 | 0.81 |
| CDH13 | 2871 | 6563892 | A | DOMINANT | 0.001664 | 0.80 |
| CDH13 | 2872 | 10514579 | C | DOMINANT | 0.002875 | 0.81 |
| CDH13 | 2873 | 444881 | G | RECESSIVE | 0.022470 | 1.26 |
| CDH13 | 2874 | 4782841 | G | RECESSIVE | 0.032078 | 1.50 |
| KIAA0182 | 2879 | 1053328 | A | DOMINANT | 0.029274 | 0.85 |
| DNAH9 | 2881 | 9904592 | A | DOMINANT | 0.004777 | 1.27 |
| DNAH9 | 2883 | 1990236 | A | ADDITIVE | 0.030533 | 0.84 |
| RAB11FIP4 | 2885 | 770520 | T | ADDITIVE | 0.041981 | 0.97 |
| CA10 | 2888 | 952258 | C | DOMINANT | 0.003866 | 1.23 |
| CA10 | 2889 | 349947 | A | DOMINANT | 0.009860 | 1.20 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| CA10 | 2890 | 349914 | G | DOMINANT | 0.009759 | 1.20 |
| CA10 | 2891 | 6504780 | T | DOMINANT | 0.024457 | 1.17 |
| CA10 | 2892 | 9916020 | G | RECESSIVE | 0.016853 | 1.28 |
| SDK2 | 2895 | 9909121 | A | DOMINANT | 0.034090 | 0.85 |
| SDK2 | 2896 | 7219778 | A | DOMINANT | 0.032294 | 0.85 |
| DLGAP1 | 2902 | 1791375 | A | ADDITIVE | 0.021983 | 0.84 |
| DLGAP1 | 2903 | 11876399 | C | ADDITIVE | 0.042241 | 0.83 |
| ZFP161 | 2904 | 9948693 | T | ADDITIVE | 0.034816 | 1.11 |
| ZFP161 | 2905 | 1539935 | C | DOMINANT | 0.023740 | 0.84 |
| ZFP161 | 2906 | 2155686 | G | DOMINANT | 0.040997 | 0.85 |
| ZFP161 | 2907 | 990072 | T | ADDITIVE | 0.037763 | 0.87 |
| ZFP161 | 2908 | 9957892 | C | RECESSIVE | 0.016403 | 1.26 |
| ZFP161 | 2909 | 11665417 | T | RECESSIVE | 0.017340 | 1.25 |
| ZFP161 | 2910 | 9945680 | A | RECESSIVE | 0.014368 | 1.26 |
| PTPRM | 2912 | 11081352 | T | DOMINANT | 0.021126 | 1.18 |
| PTPRM | 2913 | 2156236 | T | DOMINANT | 0.008387 | 1.21 |
| PTPRM | 2914 | 5000485 | T | DOMINANT | 0.009215 | 1.20 |
| PTPRM | 2915 | 1942958 | T | DOMINANT | 0.011456 | 1.20 |
| PTPRM | 2916 | 8088354 | A | DOMINANT | 0.009717 | 1.21 |
| PTPRM | 2917 | 649598 | T | DOMINANT | 0.016659 | 1.19 |
| PTPRM | 2918 | 623258 | T | DOMINANT | 0.048530 | 1.15 |
| PTPRM | 2919 | 2230601 | C | DOMINANT | 0.041904 | 1.17 |
| PTPRM | 2920 | 619379 | C | DOMINANT | 0.021461 | 1.18 |
| PTPRM | 2921 | 502843 | T | DOMINANT | 0.011208 | 1.20 |
| PTPRM | 2922 | 552448 | T | DOMINANT | 0.020617 | 1.18 |
| PTPRM | 2923 | 507445 | T | DOMINANT | 0.047780 | 1.15 |
| KIAA0802 | 2924 | 1000080 | C | ADDITIVE | 0.034821 | 0.93 |
| KIAA0802 | 2925 | 11877395 | T | ADDITIVE | 0.026018 | 0.91 |
| KIAA0802 | 2926 | 10502383 | A | ADDITIVE | 0.024860 | 0.90 |
| KIAA0802 | 2927 | 17407982 | C | ADDITIVE | 0.023943 | 0.91 |
| KIAA0802 | 2928 | 17408213 | A | ADDITIVE | 0.023207 | 0.90 |
| OSBPL1A | 2930 | 9945595 | C | DOMINANT | 0.002700 | 0.70 |
| OSBPL1A | 2931 | 275857 | C | DOMINANT | 0.004533 | 0.71 |
| FUSSEL18 | 2939 | 1434507 | T | RECESSIVE | 0.003435 | 0.66 |
| FUSSEL18 | 2940 | 1434514 | C | RECESSIVE | 0.009662 | 0.74 |
| FUSSEL18 | 2941 | 11877471 | G | RECESSIVE | 0.011304 | 0.75 |
| KIAA0427 | 2943 | 169936 | A | ADDITIVE | 0.041137 | 0.86 |
| KIAA0427 | 2944 | 1384227 | C | ADDITIVE | 0.001146 | 0.84 |
| KIAA0427 | 2945 | 1384226 | A | DOMINANT | 0.005707 | 0.82 |
| KIAA0427 | 2946 | 16949850 | G | ADDITIVE | 0.000385 | 0.83 |
| KIAA0427 | 2947 | 9947954 | C | ADDITIVE | 0.012909 | 0.86 |
| KIAA0427 | 2948 | 877885 | A | ADDITIVE | 0.000926 | 0.83 |
| DCC | 2960 | 7233997 | A | DOMINANT | 0.014859 | 0.83 |
| DCC | 2961 | 9957443 | G | DOMINANT | 0.020159 | 0.84 |
| DCC | 2963 | 2879526 | G | DOMINANT | 0.021401 | 0.85 |
| DOK6 | 2983 | 9947842 | C | RECESSIVE | 0.022893 | 1.72 |
| DOK6 | 2984 | 2364201 | T | ADDITIVE | 0.020490 | 1.15 |
| DOK6 | 2985 | 10871643 | G | ADDITIVE | 0.012735 | 1.15 |
| DOK6 | 2986 | 9964498 | T | ADDITIVE | 0.049292 | 1.05 |
| DOK6 | 2987 | 12966827 | C | ADDITIVE | 0.027862 | 1.20 |
| DOK6 | 2988 | 1550597 | C | ADDITIVE | 0.041182 | 1.18 |
| DOK6 | 2989 | 1550598 | A | ADDITIVE | 0.042207 | 1.22 |
| DOK6 | 2990 | 1992488 | C | ADDITIVE | 0.037761 | 1.20 |
| DOK6 | 2992 | 12967804 | T | RECESSIVE | 0.039890 | 1.20 |
| DOK6 | 2993 | 12968689 | A | RECESSIVE | 0.039259 | 1.20 |
| DOK6 | 2994 | 9965360 | A | DOMINANT | 0.028614 | 0.85 |
| MBP | 2996 | 12967023 | A | ADDITIVE | 0.035505 | 1.20 |
| MBP | 2997 | 17576996 | C | ADDITIVE | 0.031055 | 1.21 |
| MBP | 2998 | 7232502 | T | DOMINANT | 0.009987 | 1.21 |
| MBP | 2999 | 8085877 | G | RECESSIVE | 0.033747 | 1.27 |
| MBP | 3000 | 1868655 | C | ADDITIVE | 0.035758 | 1.09 |
| ZNF667 | 3003 | 7251105 | G | DOMINANT | 0.038115 | 0.86 |
| RNF24 | 3008 | 2143235 | A | ADDITIVE | 0.007496 | 1.24 |
| FERMT1 | 3015 | 16991765 | A | RECESSIVE | 0.001650 | 3.26 |
| FERMT1 | 3016 | 11700199 | A | RECESSIVE | 0.001192 | 4.88 |
| FERMT1 | 3017 | 11700084 | C | RECESSIVE | 0.010871 | 1.88 |
| FERMT1 | 3018 | 6516104 | T | RECESSIVE | 0.001978 | 4.07 |
| FERMT1 | 3019 | 7268391 | C | RECESSIVE | 0.002881 | 3.91 |
| PLCB1 | 3020 | 6118083 | G | RECESSIVE | 0.039048 | 0.68 |
| PLCB1 | 3026 | 1237829 | A | DOMINANT | 0.028785 | 0.86 |
| PLCB1 | 3027 | 1237071 | A | DOMINANT | 0.024043 | 0.85 |
| PLCB4 | 3033 | 6086900 | T | RECESSIVE | 0.024142 | 0.20 |
| PLCB4 | 3034 | 6077549 | T | RECESSIVE | 0.011337 | 0.65 |
| PLCB4 | 3035 | 6077552 | G | RECESSIVE | 0.043659 | 0.32 |
| MACROD2 | 3039 | 6079391 | T | RECESSIVE | 0.011533 | 1.26 |
| MACROD2 | 3041 | 2208135 | G | RECESSIVE | 0.024086 | 0.82 |

TABLE 2-continued

Alleles and Genotypes Influencing Likelihood of Diagnosis of Bipolar or Schizophrenia

| Gene | SEQ ID NO: | NCBI RS# | Allele | Model | P | Odds Ratio |
|---|---|---|---|---|---|---|
| MACROD2 | 3043 | 6074905 | A | RECESSIVE | 0.030731 | 0.82 |
| MACROD2 | 3046 | 6034296 | G | RECESSIVE | 0.033971 | 1.56 |
| MACROD2 | 3047 | 175810 | G | RECESSIVE | 0.029735 | 1.59 |
| MACROD2 | 3048 | 175805 | T | RECESSIVE | 0.039405 | 1.53 |
| MACROD2 | 3049 | 6080100 | C | DOMINANT | 0.010450 | 1.20 |
| KIF16B | 3051 | 6044021 | T | DOMINANT | 0.005183 | 0.81 |
| PTPRT | 3058 | 2223540 | T | DOMINANT | 0.042570 | 0.87 |
| KCNB1 | 3059 | 6095546 | A | DOMINANT | 0.017233 | 1.18 |
| PTGIS | 3060 | 4647 | T | DOMINANT | 0.021768 | 1.18 |
| PTGIS | 3061 | 5629 | A | DOMINANT | 0.015779 | 1.19 |
| PTGIS | 3062 | 6019876 | C | DOMINANT | 0.031979 | 1.16 |
| PTGIS | 3063 | 495146 | T | ADDITIVE | 0.044751 | 1.16 |
| BMP7 | 3065 | 6070015 | A | RECESSIVE | 0.024126 | 0.20 |
| BMP7 | 3066 | 162313 | A | DOMINANT | 0.016012 | 0.82 |
| BMP7 | 3067 | 2180782 | C | DOMINANT | 0.001178 | 0.78 |
| BMP7 | 3068 | 1015985 | A | DOMINANT | 0.013295 | 0.81 |
| BMP7 | 3069 | 6127980 | A | DOMINANT | 0.036373 | 0.84 |
| BMP7 | 3070 | 6127985 | A | DOMINANT | 0.003333 | 0.80 |
| GNAS | 3072 | 8386 | T | DOMINANT | 0.019343 | 0.60 |
| CDH4 | 3076 | 6028127 | G | RECESSIVE | 0.019399 | 0.75 |
| CDH4 | 3077 | 6061722 | C | ADDITIVE | 0.002832 | 1.11 |
| CDH4 | 3078 | 6121761 | A | DOMINANT | 0.011894 | 1.20 |
| CDH4 | 3079 | 6121764 | G | DOMINANT | 0.009310 | 1.21 |
| CDH4 | 3080 | 1317385 | C | DOMINANT | 0.006347 | 1.22 |
| CDH4 | 3082 | 2427142 | G | DOMINANT | 0.008281 | 0.82 |
| CDH4 | 3083 | 6089264 | G | DOMINANT | 0.016691 | 1.19 |
| CDH4 | 3084 | 6089476 | A | ADDITIVE | 0.018997 | 1.23 |
| CDH4 | 3085 | 6089479 | G | DOMINANT | 0.016246 | 1.19 |
| NCAM2 | 3091 | 2826349 | G | DOMINANT | 0.031339 | 0.86 |
| NCAM2 | 3092 | 2826351 | A | DOMINANT | 0.025268 | 0.85 |
| NCAM2 | 3093 | 9980583 | G | RECESSIVE | 0.002420 | 0.54 |
| PCP4 | 3110 | 1011037 | A | ADDITIVE | 0.011279 | 0.79 |
| PCP4 | 3111 | 2837283 | T | ADDITIVE | 0.034281 | 0.82 |
| PCP4 | 3112 | 2837286 | C | ADDITIVE | 0.035252 | 0.82 |
| SLC37A1 | 3114 | 228058 | A | DOMINANT | 0.023159 | 1.19 |
| SLC37A1 | 3115 | 228067 | A | DOMINANT | 0.015615 | 1.21 |
| ARVCF | 3120 | 2239395 | G | RECESSIVE | 0.017496 | >5 |
| HPS4 | 3123 | 929131 | T | ADDITIVE | 0.046458 | 0.80 |
| RIBC2 | 3141 | 5765425 | A | DOMINANT | 0.029442 | 0.85 |

Table A provides a summary of the SNPs (numbering is based on NCBI Human Genome Reference Assembly Build 36.3).

TABLE A

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1 | KIF1B | 1 | 10,323,189 | 2 | PRDM2 | 1 | 13,817,155 |
| 3 | RP1-21O18.1 | 1 | 15,149,071 | 4 | RP1-21O18.1 | 1 | 15,160,805 |
| 5 | RP1-21O18.1 | 1 | 15,278,076 | 6 | RP1-21O18.1 | 1 | 15,281,743 |
| 7 | RP1-21O18.1 | 1 | 15,284,856 | 8 | RP1-21O18.1 | 1 | 15,287,000 |
| 9 | EPHB2 | 1 | 23,091,301 | 10 | EPHB2 | 1 | 23,092,613 |
| 11 | CLIC4 | 1 | 24,939,035 | 12 | CLIC4 | 1 | 25,040,711 |
| 13 | AGBL4-C1ORF165 | 1 | 49,010,181 | 14 | AGBL4-C1ORF165 | 1 | 49,013,544 |
| 15 | AGBL4-C1ORF165 | 1 | 49,021,571 | 16 | AGBL4-C1ORF165 | 1 | 49,025,043 |
| 17 | AGBL4-C1ORF165 | 1 | 49,046,634 | 18 | AGBL4-C1ORF165 | 1 | 49,109,043 |
| 19 | AGBL4-C1ORF165 | 1 | 49,214,610 | 20 | AGBL4-C1ORF165 | 1 | 49,219,672 |
| 21 | AGBL4-C1ORF165 | 1 | 49,223,291 | 22 | AGBL4-C1ORF165 | 1 | 49,236,388 |
| 23 | AGBL4-C1ORF165 | 1 | 49,239,649 | 24 | AGBL4-C1ORF165 | 1 | 49,240,612 |
| 25 | AGBL4-C1ORF165 | 1 | 49,243,353 | 26 | AGBL4-C1ORF165 | 1 | 49,255,290 |
| 27 | AGBL4-C1ORF165 | 1 | 49,278,082 | 28 | LRP8 | 1 | 53,480,541 |
| 29 | LRP8 | 1 | 53,484,323 | 30 | LRP8 | 1 | 53,486,137 |
| 31 | LRP8 | 1 | 53,495,778 | 32 | LRP8 | 1 | 53,495,937 |
| 33 | LRP8 | 1 | 53,504,903 | 34 | LRP8 | 1 | 53,519,183 |
| 35 | LRP8 | 1 | 53,524,198 | 36 | LRP8 | 1 | 53,581,281 |
| 37 | LRP8 | 1 | 53,584,530 | 38 | LRP8 | 1 | 53,584,799 |
| 39 | PRKACB | 1 | 84,421,173 | 40 | SLC6A17 | 1 | 110,525,368 |
| 41 | SLC6A17 | 1 | 110,533,656 | 42 | SLC16A4 | 1 | 110,706,448 |
| 43 | SLC16A4 | 1 | 110,711,920 | 44 | SLC16A4 | 1 | 110,723,238 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 45 | KCNA10 | 1 | 110,862,534 | 46 | SYT6 | 1 | 114,452,599 |
| 47 | NGF | 1 | 115,662,788 | 48 | NGF | 1 | 115,668,794 |
| 49 | NGF | 1 | 115,674,570 | 50 | NGF | 1 | 115,677,168 |
| 51 | NGF | 1 | 115,679,147 | 52 | SLC22A15 | 1 | 116,328,295 |
| 53 | SLC22A15 | 1 | 116,328,591 | 54 | SLC22A15 | 1 | 116,406,946 |
| 55 | PTGFRN | 1 | 117,277,238 | 56 | PTGFRN | 1 | 117,316,638 |
| 57 | PTGFRN | 1 | 117,324,524 | 58 | PTGFRN | 1 | 117,333,336 |
| 59 | CGN | 1 | 149,743,817 | 60 | CGN | 1 | 149,743,936 |
| 61 | CGN | 1 | 149,763,826 | 62 | CGN | 1 | 149,776,650 |
| 63 | ATF6 | 1 | 160,007,898 | 64 | ATF6 | 1 | 160,014,680 |
| 65 | ATF6 | 1 | 160,038,140 | 66 | ATF6 | 1 | 160,052,935 |
| 67 | ATF6 | 1 | 160,058,351 | 68 | ATF6 | 1 | 160,062,520 |
| 69 | ATF6 | 1 | 160,076,775 | 70 | ATF6 | 1 | 160,101,070 |
| 71 | ATF6 | 1 | 160,102,111 | 72 | ATF6 | 1 | 160,107,168 |
| 73 | ATF6 | 1 | 160,118,977 | 74 | ATF6 | 1 | 160,166,085 |
| 75 | ATF6 | 1 | 160,166,355 | 76 | ATF6 | 1 | 160,173,294 |
| 77 | ATF6 | 1 | 160,176,223 | 78 | ATF6 | 1 | 160,176,587 |
| 79 | ATF6 | 1 | 160,197,100 | 80 | OLFML2B | 1 | 160,230,231 |
| 81 | OLFML2B | 1 | 160,230,414 | 82 | OLFML2B | 1 | 160,231,160 |
| 83 | OLFML2B | 1 | 160,231,641 | 84 | OLFML2B | 1 | 160,233,911 |
| 85 | FAM78B | 1 | 164,307,179 | 86 | FAM78B | 1 | 164,382,610 |
| 87 | FAM78B | 1 | 164,385,520 | 88 | FAM78B | 1 | 164,388,390 |
| 89 | FAM78B | 1 | 164,392,047 | 90 | DPT | 1 | 166,961,651 |
| 91 | SEC16B | 1 | 176,201,673 | 92 | CACNA1E | 1 | 179,723,323 |
| 93 | CACNA1E | 1 | 179,726,011 | 94 | CACNA1E | 1 | 179,745,206 |
| 95 | CACNA1E | 1 | 179,746,806 | 96 | CACNA1E | 1 | 179,845,854 |
| 97 | CACNA1E | 1 | 179,913,657 | 98 | CACNA1E | 1 | 179,939,026 |
| 99 | CACNA1E | 1 | 179,941,514 | 100 | CACNA1E | 1 | 179,980,795 |
| 101 | CACNA1E | 1 | 179,993,896 | 102 | CACNA1E | 1 | 180,019,653 |
| 103 | LAMC1 | 1 | 181,258,040 | 104 | LAMC1 | 1 | 181,290,319 |
| 105 | LAMC1 | 1 | 181,295,593 | 106 | LAMC1 | 1 | 181,299,851 |
| 107 | LAMC1 | 1 | 181,319,156 | 108 | LAMC1 | 1 | 181,342,355 |
| 109 | LAMC1 | 1 | 181,342,401 | 110 | LAMC1 | 1 | 181,343,643 |
| 111 | LAMC1 | 1 | 181,344,420 | 112 | LAMC1 | 1 | 181,344,519 |
| 113 | LAMC1 | 1 | 181,348,490 | 114 | LAMC1 | 1 | 181,352,319 |
| 115 | LAMC1 | 1 | 181,352,378 | 116 | LAMC1 | 1 | 181,359,123 |
| 117 | LAMC1 | 1 | 181,359,651 | 118 | LAMC1 | 1 | 181,366,003 |
| 119 | LAMC1 | 1 | 181,374,069 | 120 | LAMC1 | 1 | 181,375,234 |
| 121 | PLA2G4A | 1 | 185,146,514 | 122 | KCNH1 | 1 | 209,006,965 |
| 123 | KCNH1 | 1 | 209,007,097 | 124 | KCNH1 | 1 | 209,024,314 |
| 125 | KCNH1 | 1 | 209,149,546 | 126 | KCNH1 | 1 | 209,219,982 |
| 127 | KCNH1 | 1 | 209,229,662 | 128 | KCNH1 | 1 | 209,339,441 |
| 129 | KCNH1 | 1 | 209,361,502 | 130 | KCNK2 | 1 | 213,245,368 |
| 131 | KCNK2 | 1 | 213,266,926 | 132 | KCNK2 | 1 | 213,312,765 |
| 133 | KCNK2 | 1 | 213,428,830 | 134 | KCNK2 | 1 | 213,444,580 |
| 135 | KCNK2 | 1 | 213,453,686 | 136 | KCNK2 | 1 | 213,456,232 |
| 137 | KCNK2 | 1 | 213,474,680 | 138 | USH2A | 1 | 213,507,653 |
| 139 | USH2A | 1 | 213,585,997 | 140 | USH2A | 1 | 213,857,628 |
| 141 | USH2A | 1 | 213,883,311 | 142 | USH2A | 1 | 214,020,229 |
| 143 | ESRRG | 1 | 214,908,407 | 144 | ESRRG | 1 | 214,962,423 |
| 145 | SLC35F3 | 1 | 232,337,540 | 146 | SLC35F3 | 1 | 232,338,040 |
| 147 | SLC35F3 | 1 | 232,344,068 | 148 | SLC35F3 | 1 | 232,348,338 |
| 149 | SLC35F3 | 1 | 232,349,217 | 150 | SLC35F3 | 1 | 232,515,592 |
| 151 | GNG4 | 1 | 233,794,439 | 152 | GNG4 | 1 | 233,869,010 |
| 153 | GNG4 | 1 | 233,869,096 | 154 | RYR2 | 1 | 235,313,686 |
| 155 | RYR2 | 1 | 235,400,588 | 156 | RYR2 | 1 | 235,593,923 |
| 157 | RYR2 | 1 | 235,793,735 | 158 | RYR2 | 1 | 235,795,490 |
| 159 | CHRM3 | 1 | 237,867,474 | 160 | FMN2 | 1 | 238,486,712 |
| 161 | FMN2 | 1 | 238,494,888 | 162 | FMN2 | 1 | 238,564,221 |
| 163 | FMN2 | 1 | 238,564,870 | 164 | FMN2 | 1 | 238,575,081 |
| 165 | FMN2 | 1 | 238,575,190 | 166 | RGS7 | 1 | 239,432,765 |
| 167 | PLD5 | 1 | 240,696,081 | 168 | PLD5 | 1 | 240,696,530 |
| 169 | C2ORF46Â | 2 | 8,256,296 | 170 | C2ORF46Â | 2 | 8,262,682 |
| 171 | C2ORF46Â | 2 | 8,276,150 | 172 | DDEF2 | 2 | 9,293,513 |
| 173 | DDEF2 | 2 | 9,309,142 | 174 | DDEF2 | 2 | 9,320,439 |
| 175 | DDEF2 | 2 | 9,335,725 | 176 | DDEF2 | 2 | 9,347,069 |
| 177 | DDEF2 | 2 | 9,347,151 | 178 | DDEF2 | 2 | 9,351,380 |
| 179 | DDEF2 | 2 | 9,352,262 | 180 | DDEF2 | 2 | 9,352,592 |
| 181 | DDEF2 | 2 | 9,356,883 | 182 | DDEF2 | 2 | 9,358,353 |
| 183 | DDEF2 | 2 | 9,361,294 | 184 | DDEF2 | 2 | 9,375,632 |
| 185 | DDEF2 | 2 | 9,375,911 | 186 | DDEF2 | 2 | 9,376,857 |
| 187 | DDEF2 | 2 | 9,377,685 | 188 | DDEF2 | 2 | 9,383,138 |
| 189 | DDEF2 | 2 | 9,392,788 | 190 | DDEF2 | 2 | 9,398,018 |
| 191 | DDEF2 | 2 | 9,431,301 | 192 | KCNF1 | 2 | 10,935,452 |
| 193 | NAG | 2 | 15,335,505 | 194 | NAG | 2 | 15,368,097 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 195 | HS1BP3 | 2 | 20,680,974 | 196 | HS1BP3 | 2 | 20,681,154 |
| 197 | HS1BP3 | 2 | 20,702,827 | 198 | KLHL29 | 2 | 23,469,562 |
| 199 | KLHL29 | 2 | 23,482,236 | 200 | KLHL29 | 2 | 23,503,207 |
| 201 | KLHL29 | 2 | 23,504,556 | 202 | KLHL29 | 2 | 23,504,709 |
| 203 | KLHL29 | 2 | 23,504,805 | 204 | KLHL29 | 2 | 23,512,565 |
| 205 | KLHL29 | 2 | 23,518,985 | 206 | KLHL29 | 2 | 23,519,201 |
| 207 | KLHL29 | 2 | 23,529,537 | 208 | KLHL29 | 2 | 23,554,108 |
| 209 | KLHL29 | 2 | 23,554,609 | 210 | ASXL2 | 2 | 25,823,233 |
| 211 | ASXL2 | 2 | 25,859,983 | 212 | ASXL2 | 2 | 25,871,731 |
| 213 | CIB4 | 2 | 26,718,111 | 214 | KCNK3 | 2 | 26,806,502 |
| 215 | DPYSL5 | 2 | 26,936,063 | 216 | DPYSL5 | 2 | 26,936,993 |
| 217 | BRE | 2 | 27,955,442 | 218 | BRE | 2 | 28,059,085 |
| 219 | BRE | 2 | 28,085,591 | 220 | BRE | 2 | 28,094,029 |
| 221 | BRE | 2 | 28,121,971 | 222 | BRE | 2 | 28,377,338 |
| 223 | CRIM1 | 2 | 36,532,532 | 224 | CRIM1 | 2 | 36,535,123 |
| 225 | CRIM1 | 2 | 36,545,455 | 226 | CRIM1 | 2 | 36,549,124 |
| 227 | CRIM1 | 2 | 36,553,482 | 228 | CRIM1 | 2 | 36,554,084 |
| 229 | CRIM1 | 2 | 36,557,648 | 230 | CRIM1 | 2 | 36,558,502 |
| 231 | CRIM1 | 2 | 36,581,523 | 232 | CRIM1 | 2 | 36,581,946 |
| 233 | CRIM1 | 2 | 36,592,075 | 234 | CRIM1 | 2 | 36,594,147 |
| 235 | CRIM1 | 2 | 36,598,516 | 236 | CRIM1 | 2 | 36,610,853 |
| 237 | CRIM1 | 2 | 36,611,604 | 238 | FEZ2 | 2 | 36,632,391 |
| 239 | FEZ2 | 2 | 36,634,053 | 240 | FEZ2 | 2 | 36,634,284 |
| 241 | FEZ2 | 2 | 36,634,524 | 242 | FEZ2 | 2 | 36,634,642 |
| 243 | FEZ2 | 2 | 36,634,905 | 244 | FEZ2 | 2 | 36,644,730 |
| 245 | FEZ2 | 2 | 36,645,798 | 246 | FEZ2 | 2 | 36,655,361 |
| 247 | FEZ2 | 2 | 36,657,394 | 248 | FEZ2 | 2 | 36,663,977 |
| 249 | FEZ2 | 2 | 36,672,274 | 250 | FEZ2 | 2 | 36,673,724 |
| 251 | CDC42EP3 | 2 | 37,718,574 | 252 | CDC42EP3 | 2 | 37,726,375 |
| 253 | SLC8A1 | 2 | 40,381,169 | 254 | SLC8A1 | 2 | 40,406,693 |
| 255 | SLC8A1 | 2 | 40,409,237 | 256 | HAAO | 2 | 42,900,658 |
| 257 | HAAO | 2 | 42,911,782 | 258 | PLEKHH2 | 2 | 43,817,582 |
| 259 | PLEKHH2 | 2 | 43,839,444 | 260 | PLEKHH2 | 2 | 43,846,952 |
| 261 | C2ORF34 | 2 | 44,443,570 | 262 | C2ORF34 | 2 | 44,446,479 |
| 263 | C2ORF34 | 2 | 44,457,570 | 264 | C2ORF34 | 2 | 44,458,445 |
| 265 | C2ORF34 | 2 | 44,474,546 | 266 | C2ORF34 | 2 | 44,497,761 |
| 267 | C2ORF34 | 2 | 44,499,415 | 268 | C2ORF34 | 2 | 44,500,542 |
| 269 | C2ORF34 | 2 | 44,501,551 | 270 | C2ORF34 | 2 | 44,503,622 |
| 271 | C2ORF34 | 2 | 44,503,754 | 272 | C2ORF34 | 2 | 44,508,409 |
| 273 | C2ORF34 | 2 | 44,514,120 | 274 | C2ORF34 | 2 | 44,516,656 |
| 275 | C2ORF34 | 2 | 44,524,500 | 276 | C2ORF34 | 2 | 44,524,913 |
| 277 | C2ORF34 | 2 | 44,525,669 | 278 | C2ORF34 | 2 | 44,527,954 |
| 279 | C2ORF34 | 2 | 44,529,327 | 280 | C2ORF34 | 2 | 44,529,730 |
| 281 | C2ORF34 | 2 | 44,532,789 | 282 | C2ORF34 | 2 | 44,536,723 |
| 283 | C2ORF34 | 2 | 44,538,657 | 284 | C2ORF34 | 2 | 44,539,189 |
| 285 | C2ORF34 | 2 | 44,546,928 | 286 | C2ORF34 | 2 | 44,556,482 |
| 287 | C2ORF34 | 2 | 44,574,451 | 288 | C2ORF34 | 2 | 44,576,627 |
| 289 | C2ORF34 | 2 | 44,584,000 | 290 | C2ORF34 | 2 | 44,584,081 |
| 291 | C2ORF34 | 2 | 44,588,327 | 292 | C2ORF34 | 2 | 44,588,942 |
| 293 | C2ORF34 | 2 | 44,589,457 | 294 | C2ORF34 | 2 | 44,593,376 |
| 295 | C2ORF34 | 2 | 44,599,767 | 296 | C2ORF34 | 2 | 44,610,492 |
| 297 | C2ORF34 | 2 | 44,613,163 | 298 | C2ORF34 | 2 | 44,621,606 |
| 299 | C2ORF34 | 2 | 44,631,967 | 300 | C2ORF34 | 2 | 44,635,233 |
| 301 | C2ORF34 | 2 | 44,643,689 | 302 | C2ORF34 | 2 | 44,645,848 |
| 303 | C2ORF34 | 2 | 44,648,280 | 304 | C2ORF34 | 2 | 44,815,520 |
| 305 | C2ORF34 | 2 | 44,834,212 | 306 | C2ORF34 | 2 | 44,846,991 |
| 307 | PRKCE | 2 | 45,955,890 | 308 | PRKCE | 2 | 45,979,919 |
| 309 | PRKCE | 2 | 46,065,162 | 310 | PRKCE | 2 | 46,141,058 |
| 311 | EPAS1 | 2 | 46,449,937 | 312 | EPAS1 | 2 | 46,451,331 |
| 313 | EPAS1 | 2 | 46,462,046 | 314 | PSME4 | 2 | 53,987,248 |
| 315 | ACYP2 | 2 | 54,216,479 | 316 | CCDC85A | 2 | 56,457,489 |
| 317 | COMMD1 | 2 | 62,054,981 | 318 | COMMD1 | 2 | 62,127,627 |
| 319 | COMMD1 | 2 | 62,193,184 | 320 | COMMD1 | 2 | 62,221,224 |
| 321 | AAK1 | 2 | 69,569,349 | 322 | AAK1 | 2 | 69,630,234 |
| 323 | AAK1 | 2 | 69,635,501 | 324 | AAK1 | 2 | 69,637,782 |
| 325 | AAK1 | 2 | 69,685,140 | 326 | AAK1 | 2 | 69,832,899 |
| 327 | CTNNA2 | 2 | 79,635,253 | 328 | CTNNA2 | 2 | 79,726,512 |
| 329 | CTNNA2 | 2 | 79,826,944 | 330 | CTNNA2 | 2 | 80,167,469 |
| 331 | CTNNA2 | 2 | 80,218,704 | 332 | CTNNA2 | 2 | 80,251,439 |
| 333 | CTNNA2 | 2 | 80,252,218 | 334 | CTNNA2 | 2 | 80,266,636 |
| 335 | CTNNA2 | 2 | 80,266,949 | 336 | CTNNA2 | 2 | 80,274,207 |
| 337 | CTNNA2 | 2 | 80,274,788 | 338 | CTNNA2 | 2 | 80,287,912 |
| 339 | CTNNA2 | 2 | 80,288,147 | 340 | CTNNA2 | 2 | 80,299,023 |
| 341 | CTNNA2 | 2 | 80,304,589 | 342 | CTNNA2 | 2 | 80,304,695 |
| 343 | CTNNA2 | 2 | 80,305,615 | 344 | CTNNA2 | 2 | 80,313,674 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 345 | INPP4A | 2 | 98,530,592 | 346 | NAP5 | 2 | 133,502,847 |
| 347 | NAP5 | 2 | 133,546,849 | 348 | NAP5 | 2 | 133,547,260 |
| 349 | NAP5 | 2 | 133,589,500 | 350 | NAP5 | 2 | 134,042,993 |
| 351 | RAB3GAP1 | 2 | 135,513,693 | 352 | RAB3GAP1 | 2 | 135,520,236 |
| 353 | RAB3GAP1 | 2 | 135,535,377 | 354 | RAB3GAP1 | 2 | 135,607,078 |
| 355 | RAB3GAP1 | 2 | 135,624,316 | 356 | ZRANB3 | 2 | 135,867,882 |
| 357 | LRP1B | 2 | 140,711,565 | 358 | LRP1B | 2 | 140,749,675 |
| 359 | LRP1B | 2 | 141,253,166 | 360 | LRP1B | 2 | 141,287,799 |
| 361 | LRP1B | 2 | 141,480,634 | 362 | LRP1B | 2 | 141,495,066 |
| 363 | LRP1B | 2 | 141,495,534 | 364 | LRP1B | 2 | 142,281,762 |
| 365 | LRP1B | 2 | 142,298,733 | 366 | LRP1B | 2 | 142,358,098 |
| 367 | LRP1B | 2 | 142,360,248 | 368 | LRP1B | 2 | 142,363,092 |
| 369 | LRP1B | 2 | 142,363,404 | 370 | LRP1B | 2 | 142,371,205 |
| 371 | LRP1B | 2 | 142,518,411 | 372 | LRP1B | 2 | 142,529,079 |
| 373 | LRP1B | 2 | 142,529,190 | 374 | LRP1B | 2 | 142,530,425 |
| 375 | LRP1B | 2 | 142,537,344 | 376 | LRP1B | 2 | 142,544,454 |
| 377 | LRP1B | 2 | 142,568,099 | 378 | LRP1B | 2 | 142,572,993 |
| 379 | LRP1B | 2 | 142,590,723 | 380 | LRP1B | 2 | 142,591,415 |
| 381 | LRP1B | 2 | 142,592,521 | 382 | KYNU | 2 | 143,365,273 |
| 383 | KYNU | 2 | 143,436,812 | 384 | KYNU | 2 | 143,474,395 |
| 385 | ARHGAP15 | 2 | 143,773,914 | 386 | ARHGAP15 | 2 | 143,999,263 |
| 387 | ARHGAP15 | 2 | 144,018,166 | 388 | ARHGAP15 | 2 | 144,025,496 |
| 389 | ARHGAP15 | 2 | 144,034,639 | 390 | ARHGAP15 | 2 | 144,059,774 |
| 391 | ARHGAP15 | 2 | 144,264,615 | 392 | ARHGAP15 | 2 | 144,283,468 |
| 393 | ARHGAP15 | 2 | 144,294,622 | 394 | CACNB4 | 2 | 152,552,320 |
| 395 | FMNL2 | 2 | 153,113,840 | 396 | FMNL2 | 2 | 153,122,655 |
| 397 | FMNL2 | 2 | 153,123,190 | 398 | FMNL2 | 2 | 153,153,555 |
| 399 | KCNJ3 | 2 | 155,340,539 | 400 | PKP4 | 2 | 159,101,556 |
| 401 | PKP4 | 2 | 159,208,949 | 402 | PLA2R1 | 2 | 160,516,560 |
| 403 | PLA2R1 | 2 | 160,543,237 | 404 | PLA2R1 | 2 | 160,594,118 |
| 405 | PLA2R1 | 2 | 160,598,673 | 406 | PLA2R1 | 2 | 160,599,255 |
| 407 | PLA2R1 | 2 | 160,599,934 | 408 | KCNH7 | 2 | 163,243,409 |
| 409 | KCNH7 | 2 | 163,253,109 | 410 | KCNH7 | 2 | 163,256,031 |
| 411 | SCN3A | 2 | 165,694,177 | 412 | SCN2A | 2 | 165,846,854 |
| 413 | SCN2A | 2 | 165,927,516 | 414 | SCN2A | 2 | 165,927,991 |
| 415 | SCN2A | 2 | 165,948,264 | 416 | SCN1A | 2 | 166,626,965 |
| 417 | SCN1A | 2 | 166,628,663 | 418 | SCN1A | 2 | 166,629,033 |
| 419 | SCN1A | 2 | 166,632,718 | 420 | SCN1A | 2 | 166,633,217 |
| 421 | SCN1A | 2 | 166,633,417 | 422 | SCN9A | 2 | 166,764,674 |
| 423 | SCN9A | 2 | 166,814,951 | 424 | SCN9A | 2 | 166,844,835 |
| 425 | SCN9A | 2 | 166,853,220 | 426 | SCN7A | 2 | 166,970,242 |
| 427 | SCN7A | 2 | 166,991,078 | 428 | SCN7A | 2 | 167,027,829 |
| 429 | SCN7A | 2 | 167,034,898 | 430 | SCN7A | 2 | 167,056,881 |
| 431 | SCN7A | 2 | 167,057,716 | 432 | CERKL | 2 | 182,228,354 |
| 433 | PDE1A | 2 | 182,874,241 | 434 | PDE1A | 2 | 182,910,657 |
| 435 | PDE1A | 2 | 182,918,516 | 436 | PDE1A | 2 | 182,919,054 |
| 437 | PDE1A | 2 | 182,919,225 | 438 | PDE1A | 2 | 182,932,372 |
| 439 | PDE1A | 2 | 182,970,373 | 440 | PDE1A | 2 | 182,971,998 |
| 441 | NAB1 | 2 | 191,177,207 | 442 | TMEFF2 | 2 | 192,701,461 |
| 443 | TMEFF2 | 2 | 192,712,421 | 444 | TMEFF2 | 2 | 192,715,868 |
| 445 | TMEFF2 | 2 | 192,740,989 | 446 | TMEFF2 | 2 | 192,743,968 |
| 447 | ALS2Â | 2 | 202,269,099 | 448 | ABI2 | 2 | 203,952,004 |
| 449 | ABI2 | 2 | 203,985,853 | 450 | PARD3B | 2 | 205,237,235 |
| 451 | PARD3B | 2 | 205,244,163 | 452 | PARD3B | 2 | 205,538,236 |
| 453 | PARD3B | 2 | 206,182,257 | 454 | PARD3B | 2 | 206,188,103 |
| 455 | NRP2 | 2 | 206,300,940 | 456 | NRP2 | 2 | 206,301,486 |
| 457 | NRP2 | 2 | 206,318,296 | 458 | PIP5K3 | 2 | 208,843,584 |
| 459 | ERBB4 | 2 | 211,945,133 | 460 | ERBB4 | 2 | 213,507,240 |
| 461 | ERBB4 | 2 | 213,507,896 | 462 | IRS1 | 2 | 227,304,756 |
| 463 | IRS1 | 2 | 227,307,777 | 464 | IRS1 | 2 | 227,310,525 |
| 465 | IRS1 | 2 | 227,322,249 | 466 | IRS1 | 2 | 227,322,481 |
| 467 | IRS1 | 2 | 227,385,837 | 468 | IRS1 | 2 | 227,388,355 |
| 469 | COL4A4 | 2 | 227,575,963 | 470 | COL4A4 | 2 | 227,581,239 |
| 471 | COL4A4 | 2 | 227,583,201 | 472 | COL4A4 | 2 | 227,583,604 |
| 473 | COL4A4 | 2 | 227,591,892 | 474 | COL4A4 | 2 | 227,597,803 |
| 475 | COL4A4 | 2 | 227,600,105 | 476 | COL4A4 | 2 | 227,601,261 |
| 477 | COL4A4 | 2 | 227,604,676 | 478 | COL4A4 | 2 | 227,604,896 |
| 479 | COL4A4 | 2 | 227,606,678 | 480 | COL4A4 | 2 | 227,608,663 |
| 481 | COL4A4 | 2 | 227,613,183 | 482 | COL4A4 | 2 | 227,664,311 |
| 483 | COL4A3 | 2 | 227,857,351 | 484 | COL4A3 | 2 | 227,864,201 |
| 485 | COL4A3 | 2 | 227,864,848 | 486 | COL4A3 | 2 | 227,885,723 |
| 487 | COL4A3 | 2 | 227,886,069 | 488 | DNER | 2 | 229,964,830 |
| 489 | DNER | 2 | 229,972,935 | 490 | DNER | 2 | 230,109,326 |
| 491 | DNER | 2 | 230,110,447 | 492 | DNER | 2 | 230,145,109 |
| 493 | ECEL1 | 2 | 233,017,310 | 494 | CHRND | 2 | 233,088,264 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 495 | SAG | 2 | 233,912,247 | 496 | SAG | 2 | 233,912,366 |
| 497 | SAG | 2 | 233,912,663 | 498 | CENTG2 | 2 | 236,372,905 |
| 499 | CENTG2 | 2 | 236,487,308 | 500 | CENTG2 | 2 | 236,601,492 |
| 501 | CNTN6 | 3 | 1,206,334 | 502 | CNTN6 | 3 | 1,222,859 |
| 503 | CNTN6 | 3 | 1,372,069 | 504 | CNTN6 | 3 | 1,372,414 |
| 505 | CNTN6 | 3 | 1,396,673 | 506 | CNTN6 | 3 | 1,396,885 |
| 507 | CNTN6 | 3 | 1,396,900 | 508 | CNTN6 | 3 | 1,399,718 |
| 509 | CNTN6 | 3 | 1,399,850 | 510 | CNTN6 | 3 | 1,400,168 |
| 511 | CNTN6 | 3 | 1,400,506 | 512 | CNTN6 | 3 | 1,417,951 |
| 513 | CNTN4 | 3 | 2,461,763 | 514 | CNTN4 | 3 | 2,462,786 |
| 515 | CNTN4 | 3 | 2,584,580 | 516 | CNTN4 | 3 | 2,588,001 |
| 517 | CNTN4 | 3 | 2,729,042 | 518 | CNTN4 | 3 | 2,733,163 |
| 519 | CNTN4 | 3 | 2,734,283 | 520 | CNTN4 | 3 | 2,751,927 |
| 521 | CNTN4 | 3 | 3,044,773 | 522 | CNTN4 | 3 | 3,068,277 |
| 523 | CNTN4 | 3 | 3,071,927 | 524 | CNTN4 | 3 | 3,073,041 |
| 525 | ITPR1 | 3 | 4,527,968 | 526 | ITPR1 | 3 | 4,536,649 |
| 527 | ITPR1 | 3 | 4,646,029 | 528 | ITPR1 | 3 | 4,646,393 |
| 529 | ITPR1 | 3 | 4,651,285 | 530 | ITPR1 | 3 | 4,688,093 |
| 531 | IRAK2 | 3 | 10,216,875 | 532 | IRAK2 | 3 | 10,247,181 |
| 533 | IRAK2 | 3 | 10,251,163 | 534 | ATP2B2 | 3 | 10,388,601 |
| 535 | SLC6A11 | 3 | 10,844,124 | 536 | SLC6A1 | 3 | 11,055,169 |
| 537 | SLC6A6 | 3 | 14,503,422 | 538 | GADL1 | 3 | 30,846,244 |
| 539 | FBXL2 | 3 | 33,268,762 | 540 | CLASP2 | 3 | 33,516,308 |
| 541 | CLASP2 | 3 | 33,516,362 | 542 | CLASP2 | 3 | 33,584,334 |
| 543 | CLASP2 | 3 | 33,628,626 | 544 | CLASP2 | 3 | 33,712,097 |
| 545 | CLASP2 | 3 | 33,726,022 | 546 | ARPP-21 | 3 | 35,699,600 |
| 547 | ARPP-21 | 3 | 35,754,086 | 548 | ARPP-21 | 3 | 35,754,754 |
| 549 | ARPP-21 | 3 | 35,756,766 | 550 | ARPP-21 | 3 | 35,760,300 |
| 551 | ARPP-21 | 3 | 35,760,612 | 552 | STAC | 3 | 36,407,617 |
| 553 | ULK4 | 3 | 41,276,512 | 554 | ULK4 | 3 | 41,276,538 |
| 555 | ULK4 | 3 | 41,278,091 | 556 | ULK4 | 3 | 41,280,179 |
| 557 | ULK4 | 3 | 41,347,094 | 558 | ULK4 | 3 | 41,353,625 |
| 559 | ULK4 | 3 | 41,395,796 | 560 | ULK4 | 3 | 41,430,367 |
| 561 | ZNF445 | 3 | 44,472,605 | 562 | GPX1 | 3 | 49,853,082 |
| 563 | GPX1 | 3 | 49,865,617 | 564 | CAMKV | 3 | 49,877,164 |
| 565 | SEMA3F | 3 | 50,171,422 | 566 | SEMA3F | 3 | 50,200,033 |
| 567 | CACNA2D2 | 3 | 50,404,286 | 568 | CACNA2D2 | 3 | 50,406,198 |
| 569 | CACNA2D2 | 3 | 50,406,414 | 570 | CACNA2D2 | 3 | 50,424,066 |
| 571 | CACNA2D2 | 3 | 50,432,231 | 572 | CACNA2D2 | 3 | 50,436,244 |
| 573 | CACNA2D2 | 3 | 50,451,382 | 574 | CACNA2D2 | 3 | 50,458,441 |
| 575 | CACNA2D2 | 3 | 50,496,406 | 576 | CACNA2D2 | 3 | 50,499,225 |
| 577 | CACNA2D2 | 3 | 50,499,562 | 578 | CACNA2D2 | 3 | 50,500,021 |
| 579 | CACNA2D2 | 3 | 50,523,899 | 580 | CACNA2D3 | 3 | 54,123,584 |
| 581 | CACNA2D3 | 3 | 54,986,416 | 582 | CACNA2D3 | 3 | 54,986,679 |
| 583 | CACNA2D3 | 3 | 54,996,262 | 584 | CACNA2D3 | 3 | 55,011,390 |
| 585 | CACNA2D3 | 3 | 55,019,916 | 586 | ERC2 | 3 | 55,776,128 |
| 587 | ERC2 | 3 | 55,924,525 | 588 | FLNB | 3 | 58,083,555 |
| 589 | FLNB | 3 | 58,144,512 | 590 | FHIT | 3 | 59,814,275 |
| 591 | FHIT | 3 | 59,921,424 | 592 | FHIT | 3 | 59,928,545 |
| 593 | FHIT | 3 | 59,941,593 | 594 | FHIT | 3 | 59,956,110 |
| 595 | FHIT | 3 | 59,957,080 | 596 | FHIT | 3 | 59,966,929 |
| 597 | FHIT | 3 | 59,968,262 | 598 | FHIT | 3 | 60,123,563 |
| 599 | FHIT | 3 | 60,334,358 | 600 | FHIT | 3 | 60,350,356 |
| 601 | FHIT | 3 | 60,755,919 | 602 | FHIT | 3 | 60,769,257 |
| 603 | PTPRG | 3 | 62,219,610 | 604 | CADPS | 3 | 62,747,546 |
| 605 | CADPS | 3 | 62,780,447 | 606 | CADPS | 3 | 62,828,479 |
| 607 | CADPS | 3 | 62,838,021 | 608 | CADPS | 3 | 62,838,356 |
| 609 | CADPS | 3 | 62,846,542 | 610 | CADPS | 3 | 62,851,173 |
| 611 | SYNPR | 3 | 63,450,516 | 612 | SYNPR | 3 | 63,451,187 |
| 613 | SYNPR | 3 | 63,505,317 | 614 | PRICKLE2 | 3 | 64,159,383 |
| 615 | PRICKLE2 | 3 | 64,159,437 | 616 | PRICKLE2 | 3 | 64,184,717 |
| 617 | PRICKLE2 | 3 | 64,186,645 | 618 | MAGI1 | 3 | 65,576,514 |
| 619 | MAGI1 | 3 | 65,821,824 | 620 | MAGI1 | 3 | 65,836,434 |
| 621 | MAGI1 | 3 | 65,839,896 | 622 | FAM19A1 | 3 | 68,075,588 |
| 623 | FAM19A1 | 3 | 68,409,920 | 624 | ROBO2 | 3 | 77,392,802 |
| 625 | ROBO2 | 3 | 77,405,024 | 626 | ROBO1 | 3 | 78,987,206 |
| 627 | ROBO1 | 3 | 78,987,766 | 628 | ROBO1 | 3 | 79,258,557 |
| 629 | ROBO1 | 3 | 79,273,280 | 630 | ROBO1 | 3 | 79,280,400 |
| 631 | ROBO1 | 3 | 79,615,785 | 632 | GBE1 | 3 | 81,677,271 |
| 633 | EPHA3 | 3 | 89,604,354 | 634 | EPHA6 | 3 | 98,039,176 |
| 635 | CBLB | 3 | 106,905,095 | 636 | CBLB | 3 | 106,947,879 |
| 637 | CBLB | 3 | 106,982,063 | 638 | CBLB | 3 | 107,007,179 |
| 639 | CBLB | 3 | 107,007,800 | 640 | PLCXD2 | 3 | 112,846,428 |
| 641 | PLCXD2 | 3 | 112,878,258 | 642 | PLCXD2 | 3 | 112,883,336 |
| 643 | KALRN | 3 | 125,279,449 | 644 | KALRN | 3 | 125,453,554 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 645 | KALRN | 3 | 125,461,439 | 646 | KALRN | 3 | 125,649,153 |
| 647 | KALRN | 3 | 125,675,364 | 648 | KALRN | 3 | 125,678,784 |
| 649 | KALRN | 3 | 125,685,686 | 650 | KALRN | 3 | 125,904,630 |
| 651 | ZXDC | 3 | 127,661,080 | 652 | ZXDC | 3 | 127,665,610 |
| 653 | CPNE4 | 3 | 132,705,653 | 654 | CPNE4 | 3 | 132,886,287 |
| 655 | CPNE4 | 3 | 133,106,102 | 656 | CPNE4 | 3 | 133,142,633 |
| 657 | CPNE4 | 3 | 133,145,979 | 658 | EPHB1 | 3 | 135,954,344 |
| 659 | EPHB1 | 3 | 136,150,537 | 660 | EPHB1 | 3 | 136,150,839 |
| 661 | EPHB1 | 3 | 136,151,449 | 662 | EPHB1 | 3 | 136,152,557 |
| 663 | EPHB1 | 3 | 136,153,214 | 664 | EPHB1 | 3 | 136,154,213 |
| 665 | EPHB1 | 3 | 136,154,774 | 666 | EPHB1 | 3 | 136,154,975 |
| 667 | EPHB1 | 3 | 136,156,084 | 668 | EPHB1 | 3 | 136,158,491 |
| 669 | EPHB1 | 3 | 136,166,312 | 670 | EPHB1 | 3 | 136,166,631 |
| 671 | EPHB1 | 3 | 136,396,640 | 672 | SPSB4 | 3 | 142,238,268 |
| 673 | SPSB4 | 3 | 142,241,400 | 674 | SPSB4 | 3 | 142,332,653 |
| 675 | SERPINI1 | 3 | 168,993,166 | 676 | SLC7A14 | 3 | 171,664,127 |
| 677 | SLC7A14 | 3 | 171,793,139 | 678 | SLC7A14 | 3 | 171,815,650 |
| 679 | TNIK | 3 | 172,281,618 | 680 | TNIK | 3 | 172,426,406 |
| 681 | TNIK | 3 | 172,713,965 | 682 | PLD1 | 3 | 172,783,931 |
| 683 | PLD1 | 3 | 172,784,300 | 684 | PLD1 | 3 | 172,784,760 |
| 685 | PLD1 | 3 | 172,785,096 | 686 | PLD1 | 3 | 172,786,345 |
| 687 | PLD1 | 3 | 172,790,287 | 688 | PLD1 | 3 | 172,790,551 |
| 689 | PLD1 | 3 | 172,791,538 | 690 | PLD1 | 3 | 172,792,846 |
| 691 | PLD1 | 3 | 172,802,921 | 692 | PLD1 | 3 | 172,804,008 |
| 693 | PLD1 | 3 | 172,820,931 | 694 | PLD1 | 3 | 172,852,470 |
| 695 | PLD1 | 3 | 172,862,868 | 696 | PLD1 | 3 | 172,886,817 |
| 697 | PLD1 | 3 | 172,887,172 | 698 | PLD1 | 3 | 172,892,297 |
| 699 | PLD1 | 3 | 172,937,882 | 700 | PLD1 | 3 | 172,960,647 |
| 701 | PLD1 | 3 | 172,965,677 | 702 | NLGN1 | 3 | 175,040,531 |
| 703 | NLGN1 | 3 | 175,046,630 | 704 | NLGN1 | 3 | 175,512,036 |
| 705 | NLGN1 | 3 | 175,522,551 | 706 | NLGN1 | 3 | 175,541,245 |
| 707 | HTR3D | 3 | 185,244,358 | 708 | LEPREL1 | 3 | 191,232,932 |
| 709 | LEPREL1 | 3 | 191,232,980 | 710 | IL1RAP | 3 | 191,715,994 |
| 711 | IL1RAP | 3 | 191,716,369 | 712 | IL1RAP | 3 | 191,716,532 |
| 713 | IL1RAP | 3 | 191,719,452 | 714 | IL1RAP | 3 | 191,721,842 |
| 715 | IL1RAP | 3 | 191,836,940 | 716 | IL1RAP | 3 | 191,902,235 |
| 717 | IL1RAP | 3 | 191,914,335 | 718 | CENTB2 | 3 | 196,488,549 |
| 719 | SLC2A9 | 4 | 9,525,278 | 720 | SLC2A9 | 4 | 9,525,760 |
| 721 | SLC2A9 | 4 | 9,551,057 | 722 | SLC2A9 | 4 | 9,596,422 |
| 723 | SLC2A9 | 4 | 9,605,950 | 724 | SLC2A9 | 4 | 9,606,822 |
| 725 | SLC2A9 | 4 | 9,611,763 | 726 | LDB2 | 4 | 16,086,960 |
| 727 | LDB2 | 4 | 16,088,861 | 728 | LDB2 | 4 | 16,104,049 |
| 729 | LDB2 | 4 | 16,197,827 | 730 | LDB2 | 4 | 16,207,495 |
| 731 | LDB2 | 4 | 16,390,278 | 732 | LDB2 | 4 | 16,399,413 |
| 733 | LDB2 | 4 | 16,410,139 | 734 | LDB2 | 4 | 16,417,600 |
| 735 | KCNIP4 | 4 | 20,299,155 | 736 | KCNIP4 | 4 | 20,342,368 |
| 737 | KCNIP4 | 4 | 20,364,338 | 738 | KCNIP4 | 4 | 20,368,712 |
| 739 | KCNIP4 | 4 | 20,369,781 | 740 | SOD3 | 4 | 24,400,244 |
| 741 | PI4K2B | 4 | 24,837,015 | 742 | KIAA1239 | 4 | 37,121,710 |
| 743 | KIAA1239 | 4 | 37,161,668 | 744 | UBE2K | 4 | 39,394,605 |
| 745 | N4BP2 | 4 | 39,736,870 | 746 | LIMCH1 | 4 | 41,032,178 |
| 747 | LIMCH1 | 4 | 41,183,247 | 748 | LIMCH1 | 4 | 41,212,305 |
| 749 | LIMCH1 | 4 | 41,213,350 | 750 | LIMCH1 | 4 | 41,213,408 |
| 751 | LIMCH1 | 4 | 41,215,951 | 752 | LIMCH1 | 4 | 41,219,683 |
| 753 | LIMCH1 | 4 | 41,221,260 | 754 | LIMCH1 | 4 | 41,221,506 |
| 755 | LIMCH1 | 4 | 41,221,779 | 756 | LIMCH1 | 4 | 41,223,320 |
| 757 | LIMCH1 | 4 | 41,226,429 | 758 | LIMCH1 | 4 | 41,235,876 |
| 759 | LIMCH1 | 4 | 41,306,332 | 760 | LIMCH1 | 4 | 41,308,688 |
| 761 | LIMCH1 | 4 | 41,310,447 | 762 | LIMCH1 | 4 | 41,314,999 |
| 763 | LIMCH1 | 4 | 41,317,805 | 764 | LIMCH1 | 4 | 41,376,499 |
| 765 | LIMCH1 | 4 | 41,394,864 | 766 | LPHN3 | 4 | 62,506,258 |
| 767 | LPHN3 | 4 | 62,528,085 | 768 | LPHN3 | 4 | 62,708,418 |
| 769 | LPHN3 | 4 | 62,719,919 | 770 | NPFFR2 | 4 | 73,122,046 |
| 771 | NPFFR2 | 4 | 73,122,182 | 772 | NPFFR2 | 4 | 73,143,891 |
| 773 | NPFFR2 | 4 | 73,145,571 | 774 | NPFFR2 | 4 | 73,145,990 |
| 775 | NPFFR2 | 4 | 73,147,681 | 776 | NPFFR2 | 4 | 73,153,403 |
| 777 | NPFFR2 | 4 | 73,160,673 | 778 | NPFFR2 | 4 | 73,161,337 |
| 779 | NPFFR2 | 4 | 73,199,922 | 780 | NPFFR2 | 4 | 73,200,677 |
| 781 | NPFFR2 | 4 | 73,263,574 | 782 | NPFFR2 | 4 | 73,283,790 |
| 783 | NPFFR2 | 4 | 73,291,379 | 784 | SCARB2 | 4 | 77,296,450 |
| 785 | SCARB2 | 4 | 77,296,499 | 786 | SHROOM3 | 4 | 77,850,449 |
| 787 | SHROOM3 | 4 | 77,850,911 | 788 | SHROOM3 | 4 | 77,855,667 |
| 789 | SHROOM3 | 4 | 77,859,641 | 790 | SCD5 | 4 | 83,785,141 |
| 791 | GPRIN3 | 4 | 90,386,804 | 792 | GPRIN3 | 4 | 90,388,948 |
| 793 | GPRIN3 | 4 | 90,399,512 | 794 | GPRIN3 | 4 | 90,438,516 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 795 | GPRIN3 | 4 | 90,442,126 | 796 | GRID2 | 4 | 93,686,509 |
| 797 | GRID2 | 4 | 93,747,063 | 798 | GRID2 | 4 | 93,758,555 |
| 799 | GRID2 | 4 | 94,519,182 | 800 | GRID2 | 4 | 94,577,046 |
| 801 | GRID2 | 4 | 94,605,786 | 802 | GRID2 | 4 | 94,706,340 |
| 803 | GRID2 | 4 | 94,760,264 | 804 | GRID2 | 4 | 94,760,609 |
| 805 | GRID2 | 4 | 94,768,297 | 806 | GRID2 | 4 | 94,776,578 |
| 807 | GRID2 | 4 | 94,872,717 | 808 | GRID2 | 4 | 94,911,369 |
| 809 | GRID2 | 4 | 94,919,018 | 810 | GRID2 | 4 | 94,919,599 |
| 811 | UNC5C | 4 | 96,459,368 | 812 | UNC5C | 4 | 96,604,340 |
| 813 | UNC5C | 4 | 96,610,041 | 814 | UNC5C | 4 | 96,620,115 |
| 815 | UNC5C | 4 | 96,624,936 | 816 | UNC5C | 4 | 96,626,563 |
| 817 | UNC5C | 4 | 96,626,795 | 818 | UNC5C | 4 | 96,633,345 |
| 819 | UNC5C | 4 | 96,656,785 | 820 | ADH1C | 4 | 100,261,126 |
| 821 | PPP3CA | 4 | 102,128,589 | 822 | PPP3CA | 4 | 102,143,083 |
| 823 | PPP3CA | 4 | 102,187,634 | 824 | PPP3CA | 4 | 102,189,271 |
| 825 | PPP3CA | 4 | 102,198,890 | 826 | PPP3CA | 4 | 102,368,237 |
| 827 | PAPSS1 | 4 | 108,754,784 | 828 | PAPSS1 | 4 | 108,829,312 |
| 829 | PAPSS1 | 4 | 108,831,390 | 830 | PAPSS1 | 4 | 108,831,450 |
| 831 | PAPSS1 | 4 | 108,834,075 | 832 | PAPSS1 | 4 | 108,843,216 |
| 833 | PAPSS1 | 4 | 108,843,960 | 834 | PAPSS1 | 4 | 108,855,111 |
| 835 | COL25A1 | 4 | 109,985,739 | 836 | COL25A1 | 4 | 109,987,393 |
| 837 | COL25A1 | 4 | 110,067,552 | 838 | COL25A1 | 4 | 110,400,686 |
| 839 | COL25A1 | 4 | 110,409,320 | 840 | COL25A1 | 4 | 110,413,733 |
| 841 | COL25A1 | 4 | 110,474,589 | 842 | ANK2 | 4 | 114,190,823 |
| 843 | ANK2 | 4 | 114,328,632 | 844 | ANK2 | 4 | 114,329,042 |
| 845 | ANK2 | 4 | 114,329,441 | 846 | ANK2 | 4 | 114,340,609 |
| 847 | ANK2 | 4 | 114,429,212 | 848 | ANK2 | 4 | 114,437,446 |
| 849 | CAMK2D | 4 | 114,656,174 | 850 | CAMK2D | 4 | 114,715,574 |
| 851 | PRSS12 | 4 | 119,488,872 | 852 | PRSS12 | 4 | 119,498,546 |
| 853 | PRSS12 | 4 | 119,518,526 | 854 | MAML3 | 4 | 140,896,430 |
| 855 | MAML3 | 4 | 141,044,880 | 856 | MAML3 | 4 | 141,051,231 |
| 857 | MAML3 | 4 | 141,099,379 | 858 | MAML3 | 4 | 141,130,298 |
| 859 | MAML3 | 4 | 141,138,533 | 860 | MAML3 | 4 | 141,140,107 |
| 861 | MAML3 | 4 | 141,142,480 | 862 | MAML3 | 4 | 141,196,186 |
| 863 | MAML3 | 4 | 141,273,298 | 864 | MAML3 | 4 | 141,383,990 |
| 865 | IL15 | 4 | 142,737,011 | 866 | INPP4B | 4 | 143,274,371 |
| 867 | INPP4B | 4 | 143,288,240 | 868 | INPP4B | 4 | 143,292,058 |
| 869 | INPP4B | 4 | 143,296,851 | 870 | INPP4B | 4 | 143,300,521 |
| 871 | INPP4B | 4 | 143,314,721 | 872 | INPP4B | 4 | 143,392,444 |
| 873 | INPP4B | 4 | 143,414,201 | 874 | INPP4B | 4 | 143,421,104 |
| 875 | INPP4B | 4 | 143,436,841 | 876 | INPP4B | 4 | 143,437,563 |
| 877 | INPP4B | 4 | 143,508,343 | 878 | INPP4B | 4 | 143,516,488 |
| 879 | INPP4B | 4 | 143,524,042 | 880 | INPP4B | 4 | 143,547,226 |
| 881 | INPP4B | 4 | 143,563,055 | 882 | INPP4B | 4 | 143,566,886 |
| 883 | POU4F2 | 4 | 147,726,913 | 884 | POU4F2 | 4 | 147,731,368 |
| 885 | POU4F2 | 4 | 147,737,119 | 886 | POU4F2 | 4 | 147,739,219 |
| 887 | POU4F2 | 4 | 147,748,659 | 888 | POU4F2 | 4 | 147,758,283 |
| 889 | DCLK2 | 4 | 151,204,307 | 890 | DCLK2 | 4 | 151,235,111 |
| 891 | DCLK2 | 4 | 151,346,175 | 892 | DCLK2 | 4 | 151,366,761 |
| 893 | CTSO | 4 | 157,073,518 | 894 | CTSO | 4 | 157,090,787 |
| 895 | CTSO | 4 | 157,091,152 | 896 | CTSO | 4 | 157,092,343 |
| 897 | FSTL5 | 4 | 163,159,232 | 898 | FSTL5 | 4 | 163,172,602 |
| 899 | FSTL5 | 4 | 163,198,742 | 900 | FSTL5 | 4 | 163,204,852 |
| 901 | FSTL5 | 4 | 163,274,800 | 902 | FSTL5 | 4 | 163,275,058 |
| 903 | FSTL5 | 4 | 163,281,294 | 904 | FSTL5 | 4 | 163,282,207 |
| 905 | FSTL5 | 4 | 163,306,761 | 906 | FSTL5 | 4 | 163,316,993 |
| 907 | FSTL5 | 4 | 163,355,152 | 908 | FSTL5 | 4 | 163,369,235 |
| 909 | FSTL5 | 4 | 163,379,495 | 910 | TLL1 | 4 | 167,169,368 |
| 911 | TLL1 | 4 | 167,239,774 | 912 | PALLD | 4 | 169,650,759 |
| 913 | PALLD | 4 | 169,666,940 | 914 | PALLD | 4 | 169,678,372 |
| 915 | PALLD | 4 | 169,684,095 | 916 | PALLD | 4 | 169,759,910 |
| 917 | PALLD | 4 | 169,828,987 | 918 | PALLD | 4 | 169,855,143 |
| 919 | PALLD | 4 | 169,866,028 | 920 | PALLD | 4 | 169,894,890 |
| 921 | PALLD | 4 | 169,910,404 | 922 | PALLD | 4 | 170,065,920 |
| 923 | PALLD | 4 | 170,082,830 | 924 | PALLD | 4 | 170,113,748 |
| 925 | PALLD | 4 | 170,117,820 | 926 | PALLD | 4 | 170,118,492 |
| 927 | PALLD | 4 | 170,135,598 | 928 | GPM6A | 4 | 176,811,484 |
| 929 | GPM6A | 4 | 177,178,625 | 930 | ODZ3 | 4 | 183,917,599 |
| 931 | ODZ3 | 4 | 183,918,042 | 932 | ODZ3 | 4 | 183,918,858 |
| 933 | ENPP6 | 4 | 185,228,598 | 934 | ENPP6 | 4 | 185,266,961 |
| 935 | CASP3 | 4 | 185,808,551 | 936 | SLC6A3 | 5 | 1,415,793 |
| 937 | SLC6A3 | 5 | 1,480,803 | 938 | SLC6A3 | 5 | 1,481,011 |
| 939 | SLC6A3 | 5 | 1,481,514 | 940 | SLC6A3 | 5 | 1,496,728 |
| 941 | SEMA5A | 5 | 9,243,404 | 942 | SEMA5A | 5 | 9,495,994 |
| 943 | SEMA5A | 5 | 9,611,762 | 944 | SEMA5A | 5 | 9,612,903 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 945 | SEMA5A | 5 | 9,613,249 | 946 | CTNND2 | 5 | 11,160,238 |
| 947 | CTNND2 | 5 | 11,207,447 | 948 | CTNND2 | 5 | 11,250,495 |
| 949 | CTNND2 | 5 | 11,252,301 | 950 | CTNND2 | 5 | 11,271,488 |
| 951 | CTNND2 | 5 | 11,351,223 | 952 | CTNND2 | 5 | 11,476,628 |
| 953 | CTNND2 | 5 | 11,478,745 | 954 | CTNND2 | 5 | 11,975,555 |
| 955 | CTNND2 | 5 | 11,975,628 | 956 | CTNND2 | 5 | 11,982,913 |
| 957 | CTNND2 | 5 | 12,002,210 | 958 | CTNND2 | 5 | 12,002,315 |
| 959 | DNAH5 | 5 | 13,774,378 | 960 | DNAH5 | 5 | 13,957,400 |
| 961 | DNAH5 | 5 | 13,963,535 | 962 | MYO10 | 5 | 16,711,524 |
| 963 | MYO10 | 5 | 17,022,392 | 964 | BASP1 | 5 | 17,264,649 |
| 965 | BASP1 | 5 | 17,266,319 | 966 | BASP1 | 5 | 17,266,365 |
| 967 | CDH10 | 5 | 24,643,409 | 968 | CDH10 | 5 | 24,645,127 |
| 969 | CDH10 | 5 | 24,674,827 | 970 | C1QTNF3 | 5 | 34,051,438 |
| 971 | C1QTNF3 | 5 | 34,054,261 | 972 | C1QTNF3 | 5 | 34,058,118 |
| 973 | C1QTNF3 | 5 | 34,091,777 | 974 | SLC1A3 | 5 | 36,637,612 |
| 975 | SLC1A3 | 5 | 36,668,160 | 976 | EGFLAM | 5 | 38,301,820 |
| 977 | EGFLAM | 5 | 38,357,801 | 978 | EGFLAM | 5 | 38,386,400 |
| 979 | ITGA1 | 5 | 52,111,244 | 980 | ITGA1 | 5 | 52,114,759 |
| 981 | ITGA1 | 5 | 52,130,669 | 982 | ITGA1 | 5 | 52,134,676 |
| 983 | ITGA1 | 5 | 52,185,208 | 984 | ITGA1 | 5 | 52,185,286 |
| 985 | ITGA1 | 5 | 52,190,752 | 986 | ITGA1 | 5 | 52,285,233 |
| 987 | ITGA1 | 5 | 52,294,108 | 988 | ITGA2 | 5 | 52,369,177 |
| 989 | ITGA2 | 5 | 52,376,821 | 990 | ITGA2 | 5 | 52,388,971 |
| 991 | ITGA2 | 5 | 52,394,644 | 992 | ITGA2 | 5 | 52,394,794 |
| 993 | ITGA2 | 5 | 52,406,189 | 994 | ITGA2 | 5 | 52,417,975 |
| 995 | ITGA2 | 5 | 52,418,412 | 996 | ITGA2 | 5 | 52,418,682 |
| 997 | PDE4D | 5 | 58,406,595 | 998 | PDE4D | 5 | 58,429,089 |
| 999 | PDE4D | 5 | 58,511,874 | 1000 | PDE4D | 5 | 58,669,849 |
| 1001 | PDE4D | 5 | 58,895,884 | 1002 | PDE4D | 5 | 58,935,951 |
| 1003 | PDE4D | 5 | 58,937,131 | 1004 | PDE4D | 5 | 58,941,526 |
| 1005 | ELOVL7 | 5 | 60,099,268 | 1006 | ELOVL7 | 5 | 60,102,082 |
| 1007 | ELOVL7 | 5 | 60,131,029 | 1008 | ELOVL7 | 5 | 60,132,254 |
| 1009 | ELOVL7 | 5 | 60,152,959 | 1010 | ELOVL7 | 5 | 60,171,719 |
| 1011 | ELOVL7 | 5 | 60,201,944 | 1012 | PIK3R1 | 5 | 67,558,478 |
| 1013 | PIK3R1 | 5 | 67,564,947 | 1014 | MAP1B | 5 | 71,528,490 |
| 1015 | TNPO1 | 5 | 72,201,677 | 1016 | TNPO1 | 5 | 72,268,268 |
| 1017 | FCHO2 | 5 | 72,359,464 | 1018 | FCHO2 | 5 | 72,382,846 |
| 1019 | FCHO2 | 5 | 72,397,388 | 1020 | FCHO2 | 5 | 72,397,906 |
| 1021 | FCHO2 | 5 | 72,401,612 | 1022 | FCHO2 | 5 | 72,413,771 |
| 1023 | FCHO2 | 5 | 72,429,851 | 1024 | PDE8B | 5 | 76,535,298 |
| 1025 | PDE8B | 5 | 76,549,775 | 1026 | PDE8B | 5 | 76,656,410 |
| 1027 | PDE8B | 5 | 76,659,055 | 1028 | PDE8B | 5 | 76,676,601 |
| 1029 | PDE8B | 5 | 76,707,804 | 1030 | PDE8B | 5 | 76,712,714 |
| 1031 | PDE8B | 5 | 76,728,438 | 1032 | PDE8B | 5 | 76,753,826 |
| 1033 | PDE8B | 5 | 76,761,338 | 1034 | SCAMP1 | 5 | 77,716,826 |
| 1035 | SCAMP1 | 5 | 77,744,823 | 1036 | SCAMP1 | 5 | 77,754,972 |
| 1037 | SCAMP1 | 5 | 77,755,075 | 1038 | SCAMP1 | 5 | 77,775,583 |
| 1039 | SCAMP1 | 5 | 77,780,932 | 1040 | SCAMP1 | 5 | 77,781,293 |
| 1041 | SCAMP1 | 5 | 77,804,758 | 1042 | SCAMP1 | 5 | 77,818,845 |
| 1043 | SCAMP1 | 5 | 77,822,520 | 1044 | CMYA5 | 5 | 79,056,182 |
| 1045 | CMYA5 | 5 | 79,058,467 | 1046 | CMYA5 | 5 | 79,060,490 |
| 1047 | CMYA5 | 5 | 79,073,027 | 1048 | CMYA5 | 5 | 79,073,240 |
| 1049 | CMYA5 | 5 | 79,074,951 | 1050 | CMYA5 | 5 | 79,076,813 |
| 1051 | CMYA5 | 5 | 79,136,873 | 1052 | MEF2C | 5 | 88,039,159 |
| 1053 | MEF2C | 5 | 88,074,146 | 1054 | MEF2C | 5 | 88,078,052 |
| 1055 | MEF2C | 5 | 88,090,048 | 1056 | MEF2C | 5 | 88,090,519 |
| 1057 | MEF2C | 5 | 88,156,944 | 1058 | MEF2C | 5 | 88,159,879 |
| 1059 | MEF2C | 5 | 88,161,609 | 1060 | MEF2C | 5 | 88,173,798 |
| 1061 | GPR98 | 5 | 89,883,625 | 1062 | GPR98 | 5 | 89,893,330 |
| 1063 | GPR98 | 5 | 90,010,394 | 1064 | GPR98 | 5 | 90,058,163 |
| 1065 | GPR98 | 5 | 90,064,161 | 1066 | GPR98 | 5 | 90,071,845 |
| 1067 | GPR98 | 5 | 90,379,334 | 1068 | GPR98 | 5 | 90,420,854 |
| 1069 | GPR98 | 5 | 90,428,377 | 1070 | FBXL17 | 5 | 107,377,610 |
| 1071 | FBXL17 | 5 | 107,380,193 | 1072 | FBXL17 | 5 | 107,381,014 |
| 1073 | FBXL17 | 5 | 107,420,461 | 1074 | FBXL17 | 5 | 107,423,133 |
| 1075 | FBXL17 | 5 | 107,428,404 | 1076 | FBXL17 | 5 | 107,429,502 |
| 1077 | FBXL17 | 5 | 107,433,375 | 1078 | FBXL17 | 5 | 107,522,936 |
| 1079 | FBXL17 | 5 | 107,546,460 | 1080 | FBXL17 | 5 | 107,564,803 |
| 1081 | PJA2 | 5 | 108,686,797 | 1082 | PJA2 | 5 | 108,694,666 |
| 1083 | PJA2 | 5 | 108,727,060 | 1084 | PJA2 | 5 | 108,727,773 |
| 1085 | PJA2 | 5 | 108,758,672 | 1086 | PJA2 | 5 | 108,776,974 |
| 1087 | PJA2 | 5 | 108,780,765 | 1088 | PJA2 | 5 | 108,781,038 |
| 1089 | PJA2 | 5 | 108,782,510 | 1090 | PJA2 | 5 | 108,784,484 |
| 1091 | PJA2 | 5 | 108,787,364 | 1092 | PJA2 | 5 | 108,803,710 |
| 1093 | PJA2 | 5 | 108,812,698 | 1094 | KCNN2 | 5 | 113,836,032 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1095 | KCNN2 | 5 | 113,836,263 | 1096 | SEMA6A | 5 | 115,855,255 |
| 1097 | SEMA6A | 5 | 115,855,306 | 1098 | ADAMTS19 | 5 | 128,915,938 |
| 1099 | ADAMTS19 | 5 | 128,968,517 | 1100 | ADAMTS19 | 5 | 128,968,799 |
| 1101 | ADAMTS19 | 5 | 128,986,841 | 1102 | ADAMTS19 | 5 | 129,018,892 |
| 1103 | ADAMTS19 | 5 | 129,019,131 | 1104 | ADAMTS19 | 5 | 129,024,772 |
| 1105 | ADAMTS19 | 5 | 129,033,634 | 1106 | ADAMTS19 | 5 | 129,034,142 |
| 1107 | ADAMTS19 | 5 | 129,039,887 | 1108 | ADAMTS19 | 5 | 129,078,440 |
| 1109 | VDAC1 | 5 | 133,335,005 | 1110 | VDAC1 | 5 | 133,355,058 |
| 1111 | VDAC1 | 5 | 133,356,459 | 1112 | VDAC1 | 5 | 133,405,061 |
| 1113 | TRPC7 | 5 | 135,547,908 | 1114 | TRPC7 | 5 | 135,551,643 |
| 1115 | TRPC7 | 5 | 135,557,803 | 1116 | TRPC7 | 5 | 135,660,209 |
| 1117 | TRPC7 | 5 | 135,674,104 | 1118 | TRPC7 | 5 | 135,678,197 |
| 1119 | TRPC7 | 5 | 135,679,839 | 1120 | TRPC7 | 5 | 135,680,121 |
| 1121 | TRPC7 | 5 | 135,689,800 | 1122 | TRPC7 | 5 | 135,693,248 |
| 1123 | TRPC7 | 5 | 135,708,380 | 1124 | TRPC7 | 5 | 135,712,132 |
| 1125 | TRPC7 | 5 | 135,713,994 | 1126 | TRPC7 | 5 | 135,724,949 |
| 1127 | TRPC7 | 5 | 135,725,523 | 1128 | TRPC7 | 5 | 135,733,573 |
| 1129 | TRPC7 | 5 | 135,734,750 | 1130 | GRIA1 | 5 | 152,884,137 |
| 1131 | GRIA1 | 5 | 152,949,087 | 1132 | GRIA1 | 5 | 152,956,518 |
| 1133 | GRIA1 | 5 | 153,167,666 | 1134 | ODZ2 | 5 | 166,910,625 |
| 1135 | ODZ2 | 5 | 167,105,972 | 1136 | ODZ2 | 5 | 167,177,338 |
| 1137 | ODZ2 | 5 | 167,189,249 | 1138 | ODZ2 | 5 | 167,313,056 |
| 1139 | ODZ2 | 5 | 167,345,783 | 1140 | ODZ2 | 5 | 167,400,913 |
| 1141 | ODZ2 | 5 | 167,601,421 | 1142 | ODZ2 | 5 | 167,604,683 |
| 1143 | ODZ2 | 5 | 167,611,516 | 1144 | ODZ2 | 5 | 167,634,619 |
| 1145 | WWC1 | 5 | 167,641,813 | 1146 | WWC1 | 5 | 167,785,852 |
| 1147 | WWC1 | 5 | 167,818,328 | 1148 | WWC1 | 5 | 167,819,115 |
| 1149 | WWC1 | 5 | 167,819,275 | 1150 | WWC1 | 5 | 167,820,009 |
| 1151 | KCNIP1 | 5 | 169,709,852 | 1152 | KCNIP1 | 5 | 169,709,936 |
| 1153 | KCNIP1 | 5 | 169,710,014 | 1154 | KCNIP1 | 5 | 170,021,180 |
| 1155 | KCNIP1 | 5 | 170,078,162 | 1156 | KCNIP1 | 5 | 170,095,949 |
| 1157 | STK10 | 5 | 171,538,167 | 1158 | EXOC2 | 6 | 417,807 |
| 1159 | EXOC2 | 6 | 418,248 | 1160 | EXOC2 | 6 | 420,154 |
| 1161 | EXOC2 | 6 | 420,810 | 1162 | EXOC2 | 6 | 441,555 |
| 1163 | EXOC2 | 6 | 536,765 | 1164 | EXOC2 | 6 | 541,042 |
| 1165 | EXOC2 | 6 | 542,871 | 1166 | EXOC2 | 6 | 555,542 |
| 1167 | EXOC2 | 6 | 559,375 | 1168 | EXOC2 | 6 | 577,061 |
| 1169 | SERPINB6 | 6 | 2,876,878 | 1170 | SERPINB6 | 6 | 2,926,223 |
| 1171 | PHACTR1 | 6 | 12,837,251 | 1172 | PHACTR1 | 6 | 13,386,732 |
| 1173 | JARID2 | 6 | 15,355,372 | 1174 | JARID2 | 6 | 15,499,187 |
| 1175 | JARID2 | 6 | 15,503,960 | 1176 | JARID2 | 6 | 15,505,614 |
| 1177 | JARID2 | 6 | 15,512,229 | 1178 | JARID2 | 6 | 15,516,507 |
| 1179 | JARID2 | 6 | 15,537,710 | 1180 | JARID2 | 6 | 15,545,369 |
| 1181 | JARID2 | 6 | 15,567,913 | 1182 | JARID2 | 6 | 15,598,338 |
| 1183 | ATXN1 | 6 | 16,595,223 | 1184 | ATXN1 | 6 | 16,595,385 |
| 1185 | ATXN1 | 6 | 16,681,514 | 1186 | ATXN1 | 6 | 16,755,137 |
| 1187 | ATXN1 | 6 | 16,762,029 | 1188 | ATXN1 | 6 | 16,766,596 |
| 1189 | ATXN1 | 6 | 16,767,074 | 1190 | ATXN1 | 6 | 16,767,110 |
| 1191 | ATXN1 | 6 | 16,779,315 | 1192 | ATXN1 | 6 | 16,780,739 |
| 1193 | ATXN1 | 6 | 16,791,838 | 1194 | ATXN1 | 6 | 16,799,821 |
| 1195 | ATXN1 | 6 | 16,850,744 | 1196 | SLC17A4 | 6 | 25,880,026 |
| 1197 | SLC17A4 | 6 | 25,880,618 | 1198 | SLC17A4 | 6 | 25,887,371 |
| 1199 | SLC17A1 | 6 | 25,909,950 | 1200 | SLC17A1 | 6 | 25,921,129 |
| 1201 | SLC17A1 | 6 | 25,926,734 | 1202 | SLC17A1 | 6 | 25,928,407 |
| 1203 | SLC17A1 | 6 | 25,948,464 | 1204 | SLC17A1 | 6 | 25,949,101 |
| 1205 | SLC17A3 | 6 | 25,967,533 | 1206 | SLC17A3 | 6 | 25,970,445 |
| 1207 | SLC17A3 | 6 | 25,971,584 | 1208 | SLC17A3 | 6 | 25,972,877 |
| 1209 | SLC17A3 | 6 | 25,973,245 | 1210 | SLC17A3 | 6 | 25,977,827 |
| 1211 | SLC17A3 | 6 | 25,978,521 | 1212 | BTN3A1 | 6 | 26,504,182 |
| 1213 | BTN3A1 | 6 | 26,506,534 | 1214 | BTN3A1 | 6 | 26,512,353 |
| 1215 | BTN3A1 | 6 | 26,513,243 | 1216 | BTN3A1 | 6 | 26,513,969 |
| 1217 | MSH5 | 6 | 31,826,581 | 1218 | MSH5 | 6 | 31,838,993 |
| 1219 | LRFN2 | 6 | 40,635,612 | 1220 | LRFN2 | 6 | 40,640,871 |
| 1221 | KLC4 | 6 | 43,131,349 | 1222 | PARC | 6 | 43,293,711 |
| 1223 | TJAP1 | 6 | 43,598,787 | 1224 | XPO5 | 6 | 43,606,651 |
| 1225 | XPO5 | 6 | 43,621,785 | 1226 | XPO5 | 6 | 43,636,419 |
| 1227 | XPO5 | 6 | 43,648,904 | 1228 | TMEM63B | 6 | 44,201,720 |
| 1229 | ELOVL5 | 6 | 53,213,187 | 1230 | ELOVL5 | 6 | 53,282,407 |
| 1231 | ELOVL5 | 6 | 53,341,053 | 1232 | ELOVL5 | 6 | 53,350,763 |
| 1233 | ELOVL5 | 6 | 53,362,070 | 1234 | RIMS1 | 6 | 72,866,546 |
| 1235 | RIMS1 | 6 | 72,932,594 | 1236 | HTR1B | 6 | 78,228,979 |
| 1237 | HTR1B | 6 | 78,247,981 | 1238 | GABRR2 | 6 | 90,031,297 |
| 1239 | GABRR2 | 6 | 90,052,273 | 1240 | TRDN | 6 | 123,681,714 |
| 1241 | TRDN | 6 | 123,707,645 | 1242 | TRDN | 6 | 123,730,952 |
| 1243 | TRDN | 6 | 123,731,764 | 1244 | TRDN | 6 | 123,747,133 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1245 | TRDN | 6 | 123,749,431 | 1246 | TRDN | 6 | 123,753,539 |
| 1247 | TRDN | 6 | 123,790,942 | 1248 | TRDN | 6 | 123,878,251 |
| 1249 | TRDN | 6 | 123,963,305 | 1250 | TRDN | 6 | 123,982,387 |
| 1251 | TRDN | 6 | 123,983,371 | 1252 | TRDN | 6 | 123,983,783 |
| 1253 | TRDN | 6 | 123,991,308 | 1254 | TRDN | 6 | 123,992,112 |
| 1255 | TRDN | 6 | 124,006,657 | 1256 | TRDN | 6 | 124,007,196 |
| 1257 | TRDN | 6 | 124,008,072 | 1258 | TRDN | 6 | 124,011,033 |
| 1259 | NKAIN2 | 6 | 124,074,609 | 1260 | NKAIN2 | 6 | 124,085,957 |
| 1261 | NKAIN2 | 6 | 124,977,809 | 1262 | EYA4 | 6 | 133,668,941 |
| 1263 | EYA4 | 6 | 133,672,254 | 1264 | EYA4 | 6 | 133,678,316 |
| 1265 | EYA4 | 6 | 133,684,611 | 1266 | PDE7B | 6 | 136,337,547 |
| 1267 | PDE7B | 6 | 136,391,000 | 1268 | PDE7B | 6 | 136,402,540 |
| 1269 | PDE7B | 6 | 136,472,958 | 1270 | PDE7B | 6 | 136,555,234 |
| 1271 | PLAGL1 | 6 | 144,345,925 | 1272 | PLAGL1 | 6 | 144,355,380 |
| 1273 | STX11 | 6 | 144,554,694 | 1274 | UTRN | 6 | 144,943,208 |
| 1275 | UTRN | 6 | 145,213,578 | 1276 | SYNE1 | 6 | 152,534,210 |
| 1277 | SYNE1 | 6 | 152,534,429 | 1278 | SYNE1 | 6 | 152,535,158 |
| 1279 | SYNE1 | 6 | 152,535,230 | 1280 | SYNE1 | 6 | 152,549,890 |
| 1281 | SLC22A3 | 6 | 160,664,141 | 1282 | SLC22A3 | 6 | 160,701,723 |
| 1283 | PARK2 | 6 | 161,894,294 | 1284 | PARK2 | 6 | 161,894,946 |
| 1285 | PACRG | 6 | 163,512,225 | 1286 | PACRG | 6 | 163,523,252 |
| 1287 | PACRG | 6 | 163,571,731 | 1288 | PACRG | 6 | 163,656,492 |
| 1289 | PDE10A | 6 | 165,656,576 | 1290 | PDE10A | 6 | 165,657,424 |
| 1291 | PDE10A | 6 | 165,659,019 | 1292 | PDE10A | 6 | 165,711,808 |
| 1293 | PDE10A | 6 | 165,865,960 | 1294 | PDE10A | 6 | 165,868,876 |
| 1295 | SDK1 | 7 | 4,133,862 | 1296 | SDK1 | 7 | 4,141,415 |
| 1297 | SDK1 | 7 | 4,142,841 | 1298 | NXPH1 | 7 | 8,633,152 |
| 1299 | NXPH1 | 7 | 8,633,615 | 1300 | NXPH1 | 7 | 8,637,519 |
| 1301 | NXPH1 | 7 | 8,642,990 | 1302 | NXPH1 | 7 | 8,647,759 |
| 1303 | NXPH1 | 7 | 8,662,332 | 1304 | NXPH1 | 7 | 8,662,442 |
| 1305 | NXPH1 | 7 | 8,758,143 | 1306 | ETV1 | 7 | 13,882,768 |
| 1307 | DGKB | 7 | 14,179,937 | 1308 | DGKB | 7 | 14,181,086 |
| 1309 | DGKB | 7 | 14,213,223 | 1310 | DGKB | 7 | 14,213,591 |
| 1311 | DGKB | 7 | 14,557,877 | 1312 | DGKB | 7 | 14,663,822 |
| 1313 | DGKB | 7 | 14,795,170 | 1314 | DGKB | 7 | 14,816,578 |
| 1315 | DGKB | 7 | 14,817,686 | 1316 | DGKB | 7 | 14,818,142 |
| 1317 | TSPAN13 | 7 | 16,770,515 | 1318 | SNX13 | 7 | 17,949,822 |
| 1319 | SNX13 | 7 | 17,950,332 | 1320 | SNX13 | 7 | 17,955,884 |
| 1321 | STK31 | 7 | 23,712,523 | 1322 | STK31 | 7 | 23,790,538 |
| 1323 | STK31 | 7 | 23,796,703 | 1324 | STK31 | 7 | 23,844,516 |
| 1325 | STK31 | 7 | 23,859,520 | 1326 | SKAP2 | 7 | 26,814,684 |
| 1327 | SKAP2 | 7 | 26,825,824 | 1328 | SKAP2 | 7 | 26,830,698 |
| 1329 | SKAP2 | 7 | 26,862,761 | 1330 | CREB5 | 7 | 28,798,822 |
| 1331 | CREB5 | 7 | 28,808,592 | 1332 | PLEKHA8 | 7 | 30,037,069 |
| 1333 | PLEKHA8 | 7 | 30,081,142 | 1334 | CRHR2 | 7 | 30,665,429 |
| 1335 | PDE1C | 7 | 31,821,130 | 1336 | PDE1C | 7 | 31,822,595 |
| 1337 | PDE1C | 7 | 31,835,138 | 1338 | PDE1C | 7 | 31,838,385 |
| 1339 | PDE1C | 7 | 31,841,400 | 1340 | BMPER | 7 | 34,020,913 |
| 1341 | BMPER | 7 | 34,057,259 | 1342 | BMPER | 7 | 34,067,083 |
| 1343 | BMPER | 7 | 34,077,746 | 1344 | BMPER | 7 | 34,159,287 |
| 1345 | EEPD1 | 7 | 36,145,203 | 1346 | EEPD1 | 7 | 36,235,809 |
| 1347 | VPS41 | 7 | 38,708,501 | 1348 | VPS41 | 7 | 38,738,392 |
| 1349 | VPS41 | 7 | 38,750,276 | 1350 | VPS41 | 7 | 38,757,077 |
| 1351 | VPS41 | 7 | 38,757,472 | 1352 | VPS41 | 7 | 38,759,768 |
| 1353 | VPS41 | 7 | 38,761,292 | 1354 | VPS41 | 7 | 38,776,517 |
| 1355 | VPS41 | 7 | 38,784,656 | 1356 | VPS41 | 7 | 38,798,095 |
| 1357 | VPS41 | 7 | 38,798,875 | 1358 | VPS41 | 7 | 38,800,593 |
| 1359 | VPS41 | 7 | 38,806,116 | 1360 | VPS41 | 7 | 38,812,386 |
| 1361 | VPS41 | 7 | 38,820,297 | 1362 | VPS41 | 7 | 38,820,469 |
| 1363 | VPS41 | 7 | 38,828,636 | 1364 | VPS41 | 7 | 38,836,969 |
| 1365 | VPS41 | 7 | 38,850,065 | 1366 | VPS41 | 7 | 38,882,602 |
| 1367 | VPS41 | 7 | 38,925,791 | 1368 | VPS41 | 7 | 38,926,367 |
| 1369 | VPS41 | 7 | 38,936,691 | 1370 | IGFBP3 | 7 | 45,875,519 |
| 1371 | IGFBP3 | 7 | 45,916,971 | 1372 | IGFBP3 | 7 | 46,061,993 |
| 1373 | ABCA13 | 7 | 48,240,607 | 1374 | ABCA13 | 7 | 48,245,100 |
| 1375 | ABCA13 | 7 | 48,250,081 | 1376 | ABCA13 | 7 | 48,250,147 |
| 1377 | ABCA13 | 7 | 48,253,360 | 1378 | ABCA13 | 7 | 48,256,966 |
| 1379 | ABCA13 | 7 | 48,261,753 | 1380 | ABCA13 | 7 | 48,262,848 |
| 1381 | ABCA13 | 7 | 48,263,650 | 1382 | ABCA13 | 7 | 48,275,993 |
| 1383 | ABCA13 | 7 | 48,415,696 | 1384 | ABCA13 | 7 | 48,427,057 |
| 1385 | ABCA13 | 7 | 48,537,723 | 1386 | ABCA13 | 7 | 48,538,115 |
| 1387 | ABCA13 | 7 | 48,549,904 | 1388 | ABCA13 | 7 | 48,551,488 |
| 1389 | ABCA13 | 7 | 48,576,570 | 1390 | ABCA13 | 7 | 48,577,426 |
| 1391 | ABCA13 | 7 | 48,642,999 | 1392 | ABCA13 | 7 | 48,664,499 |
| 1393 | GRB10 | 7 | 50,706,645 | 1394 | GRB10 | 7 | 50,706,949 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1395 | GRB10 | 7 | 50,707,020 | 1396 | GRB10 | 7 | 50,707,082 |
| 1397 | GRB10 | 7 | 50,712,801 | 1398 | GRB10 | 7 | 50,723,008 |
| 1399 | GRB10 | 7 | 50,727,714 | 1400 | GRB10 | 7 | 50,735,647 |
| 1401 | GRB10 | 7 | 50,750,413 | 1402 | GRB10 | 7 | 50,752,942 |
| 1403 | GRB10 | 7 | 50,753,544 | 1404 | GRB10 | 7 | 50,769,928 |
| 1405 | GRB10 | 7 | 50,775,527 | 1406 | GRB10 | 7 | 50,775,581 |
| 1407 | GRB10 | 7 | 50,777,265 | 1408 | GRB10 | 7 | 50,790,805 |
| 1409 | GRB10 | 7 | 50,791,895 | 1410 | GRB10 | 7 | 50,797,467 |
| 1411 | GRB10 | 7 | 50,803,980 | 1412 | GRB10 | 7 | 50,807,550 |
| 1413 | GRB10 | 7 | 50,820,922 | 1414 | GRB10 | 7 | 50,823,003 |
| 1415 | GRB10 | 7 | 50,823,341 | 1416 | GRB10 | 7 | 50,839,403 |
| 1417 | GRB10 | 7 | 50,839,923 | 1418 | WBSCR17 | 7 | 70,218,616 |
| 1419 | WBSCR17 | 7 | 70,314,044 | 1420 | WBSCR17 | 7 | 70,765,881 |
| 1421 | WBSCR17 | 7 | 70,771,838 | 1422 | CALN1 | 7 | 70,886,612 |
| 1423 | CALN1 | 7 | 70,889,691 | 1424 | CALN1 | 7 | 71,180,137 |
| 1425 | CALN1 | 7 | 71,196,919 | 1426 | CALN1 | 7 | 71,206,186 |
| 1427 | CALN1 | 7 | 71,212,064 | 1428 | CALN1 | 7 | 71,214,046 |
| 1429 | CALN1 | 7 | 71,235,264 | 1430 | CALN1 | 7 | 71,235,395 |
| 1431 | CALN1 | 7 | 71,377,109 | 1432 | CALN1 | 7 | 71,446,681 |
| 1433 | CALN1 | 7 | 71,464,567 | 1434 | CALN1 | 7 | 71,472,868 |
| 1435 | CALN1 | 7 | 71,475,237 | 1436 | CALN1 | 7 | 71,505,190 |
| 1437 | GTF2IRD1 | 7 | 73,545,909 | 1438 | MAGI2 | 7 | 77,807,229 |
| 1439 | MAGI2 | 7 | 77,811,392 | 1440 | MAGI2 | 7 | 77,811,723 |
| 1441 | MAGI2 | 7 | 78,083,120 | 1442 | MAGI2 | 7 | 78,087,129 |
| 1443 | MAGI2 | 7 | 78,735,107 | 1444 | MAGI2 | 7 | 78,753,565 |
| 1445 | MAGI2 | 7 | 78,817,962 | 1446 | MAGI2 | 7 | 78,824,996 |
| 1447 | MAGI2 | 7 | 78,825,573 | 1448 | MAGI2 | 7 | 78,829,240 |
| 1449 | CACNA2D1 | 7 | 81,438,378 | 1450 | CACNA2D1 | 7 | 81,442,364 |
| 1451 | PCLO | 7 | 82,393,605 | 1452 | PCLO | 7 | 82,395,097 |
| 1453 | PCLO | 7 | 82,401,047 | 1454 | PCLO | 7 | 82,401,452 |
| 1455 | PCLO | 7 | 82,411,459 | 1456 | PCLO | 7 | 82,454,771 |
| 1457 | PCLO | 7 | 82,650,074 | 1458 | PCLO | 7 | 82,659,120 |
| 1459 | GRM3 | 7 | 86,189,153 | 1460 | GRM3 | 7 | 86,254,957 |
| 1461 | GRM3 | 7 | 86,255,781 | 1462 | GRM3 | 7 | 86,266,144 |
| 1463 | ADAM22 | 7 | 87,469,462 | 1464 | ADAM22 | 7 | 87,539,714 |
| 1465 | ADAM22 | 7 | 87,590,464 | 1466 | PPP1R9A | 7 | 94,589,831 |
| 1467 | PPP1R9A | 7 | 94,632,721 | 1468 | PPP1R9A | 7 | 94,733,892 |
| 1469 | PPP1R9A | 7 | 94,734,041 | 1470 | PPP1R9A | 7 | 94,742,812 |
| 1471 | PPP1R9A | 7 | 94,746,827 | 1472 | PPP1R9A | 7 | 94,747,431 |
| 1473 | PPP1R9A | 7 | 94,747,598 | 1474 | PPP1R9A | 7 | 94,748,184 |
| 1475 | PPP1R9A | 7 | 94,750,340 | 1476 | DYNC1I1 | 7 | 95,258,613 |
| 1477 | DYNC1I1 | 7 | 95,325,994 | 1478 | DYNC1I1 | 7 | 95,336,462 |
| 1479 | DYNC1I1 | 7 | 95,386,677 | 1480 | ZNF3 | 7 | 99,429,354 |
| 1481 | ZNF3 | 7 | 99,480,681 | 1482 | EMID2 | 7 | 100,868,518 |
| 1483 | EMID2 | 7 | 100,878,190 | 1484 | CUX1 | 7 | 101,700,855 |
| 1485 | CUX1 | 7 | 101,712,058 | 1486 | CUX1 | 7 | 101,758,636 |
| 1487 | NRCAM | 7 | 107,585,096 | 1488 | NRCAM | 7 | 107,587,783 |
| 1489 | NRCAM | 7 | 107,588,905 | 1490 | NRCAM | 7 | 107,598,938 |
| 1491 | NRCAM | 7 | 107,621,970 | 1492 | NRCAM | 7 | 107,626,668 |
| 1493 | NRCAM | 7 | 107,628,207 | 1494 | NRCAM | 7 | 107,654,504 |
| 1495 | NRCAM | 7 | 107,657,867 | 1496 | NRCAM | 7 | 107,731,054 |
| 1497 | KCND2 | 7 | 119,693,426 | 1498 | KCND2 | 7 | 119,956,552 |
| 1499 | KCND2 | 7 | 119,967,907 | 1500 | KCND2 | 7 | 120,089,523 |
| 1501 | CADPS2 | 7 | 121,760,839 | 1502 | CADPS2 | 7 | 121,767,778 |
| 1503 | CADPS2 | 7 | 121,805,395 | 1504 | CADPS2 | 7 | 122,314,434 |
| 1505 | SLC13A1 | 7 | 122,533,104 | 1506 | SLC13A1 | 7 | 122,557,321 |
| 1507 | SLC13A1 | 7 | 122,560,268 | 1508 | SLC13A1 | 7 | 122,590,060 |
| 1509 | SLC13A1 | 7 | 122,594,916 | 1510 | SLC13A1 | 7 | 122,595,280 |
| 1511 | SLC13A1 | 7 | 122,596,347 | 1512 | GRM8 | 7 | 125,866,380 |
| 1513 | GRM8 | 7 | 125,872,156 | 1514 | GRM8 | 7 | 125,880,817 |
| 1515 | GRM8 | 7 | 125,918,108 | 1516 | GRM8 | 7 | 125,923,221 |
| 1517 | GRM8 | 7 | 125,938,463 | 1518 | GRM8 | 7 | 125,940,799 |
| 1519 | GRM8 | 7 | 125,941,472 | 1520 | GRM8 | 7 | 125,959,757 |
| 1521 | GRM8 | 7 | 125,979,607 | 1522 | GRM8 | 7 | 126,435,292 |
| 1523 | GRM8 | 7 | 126,436,133 | 1524 | GRM8 | 7 | 126,444,781 |
| 1525 | GRM8 | 7 | 126,483,848 | 1526 | GRM8 | 7 | 126,499,299 |
| 1527 | GRM8 | 7 | 126,499,423 | 1528 | GRM8 | 7 | 126,504,393 |
| 1529 | GRM8 | 7 | 126,521,407 | 1530 | GRM8 | 7 | 126,581,967 |
| 1531 | GRM8 | 7 | 126,624,857 | 1532 | DGKI | 7 | 136,749,535 |
| 1533 | DGKI | 7 | 136,757,487 | 1534 | DGKI | 7 | 136,769,973 |
| 1535 | DGKI | 7 | 136,780,737 | 1536 | DGKI | 7 | 136,782,783 |
| 1537 | DGKI | 7 | 136,787,596 | 1538 | DGKI | 7 | 136,885,223 |
| 1539 | DGKI | 7 | 136,888,628 | 1540 | DGKI | 7 | 136,888,749 |
| 1541 | CREB3L2 | 7 | 137,203,650 | 1542 | CREB3L2 | 7 | 137,211,237 |
| 1543 | CREB3L2 | 7 | 137,342,248 | 1544 | CREB3L2 | 7 | 137,343,428 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1545 | TBXAS1 | 7 | 139,342,717 | 1546 | TBXAS1 | 7 | 139,369,869 |
| 1547 | CNTNAP2 | 7 | 146,670,511 | 1548 | CNTNAP2 | 7 | 146,671,711 |
| 1549 | CNTNAP2 | 7 | 146,671,930 | 1550 | CNTNAP2 | 7 | 146,673,648 |
| 1551 | CNTNAP2 | 7 | 146,706,249 | 1552 | CNTNAP2 | 7 | 146,723,973 |
| 1553 | CNTNAP2 | 7 | 146,724,262 | 1554 | CNTNAP2 | 7 | 146,782,515 |
| 1555 | CNTNAP2 | 7 | 146,786,412 | 1556 | CNTNAP2 | 7 | 146,786,448 |
| 1557 | CNTNAP2 | 7 | 146,788,290 | 1558 | CNTNAP2 | 7 | 146,791,664 |
| 1559 | CNTNAP2 | 7 | 146,791,891 | 1560 | CNTNAP2 | 7 | 146,792,055 |
| 1561 | CNTNAP2 | 7 | 146,792,712 | 1562 | CNTNAP2 | 7 | 146,794,158 |
| 1563 | CNTNAP2 | 7 | 146,795,212 | 1564 | CNTNAP2 | 7 | 146,795,377 |
| 1565 | CNTNAP2 | 7 | 146,795,593 | 1566 | CNTNAP2 | 7 | 146,798,866 |
| 1567 | CNTNAP2 | 7 | 146,800,067 | 1568 | CNTNAP2 | 7 | 146,800,208 |
| 1569 | CNTNAP2 | 7 | 146,816,270 | 1570 | CNTNAP2 | 7 | 146,816,456 |
| 1571 | CNTNAP2 | 7 | 147,067,210 | 1572 | CNTNAP2 | 7 | 147,088,310 |
| 1573 | CNTNAP2 | 7 | 147,748,379 | 1574 | ACCN3 | 7 | 150,382,999 |
| 1575 | DPP6 | 7 | 154,100,079 | 1576 | DPP6 | 7 | 154,132,604 |
| 1577 | DPP6 | 7 | 154,143,043 | 1578 | HTR5A | 7 | 154,513,733 |
| 1579 | HTR5A | 7 | 154,518,336 | 1580 | PTPRN2 | 7 | 157,055,372 |
| 1581 | PTPRN2 | 7 | 157,060,284 | 1582 | PTPRN2 | 7 | 157,062,744 |
| 1583 | PTPRN2 | 7 | 157,509,808 | 1584 | PTPRN2 | 7 | 157,519,106 |
| 1585 | PTPRN2 | 7 | 157,647,665 | 1586 | CSMD1 | 8 | 2,793,553 |
| 1587 | CSMD1 | 8 | 2,795,939 | 1588 | CSMD1 | 8 | 3,202,280 |
| 1589 | CSMD1 | 8 | 3,202,904 | 1590 | CSMD1 | 8 | 3,218,544 |
| 1591 | CSMD1 | 8 | 3,228,881 | 1592 | CSMD1 | 8 | 3,242,988 |
| 1593 | CSMD1 | 8 | 3,245,103 | 1594 | CSMD1 | 8 | 3,246,122 |
| 1595 | CSMD1 | 8 | 3,248,205 | 1596 | CSMD1 | 8 | 3,252,146 |
| 1597 | MCPH1 | 8 | 6,305,755 | 1598 | MCPH1 | 8 | 6,355,722 |
| 1599 | MCPH1 | 8 | 6,357,338 | 1600 | MCPH1 | 8 | 6,362,452 |
| 1601 | MCPH1 | 8 | 6,383,317 | 1602 | MCPH1 | 8 | 6,384,278 |
| 1603 | MCPH1 | 8 | 6,384,838 | 1604 | MCPH1 | 8 | 6,402,090 |
| 1605 | MCPH1 | 8 | 6,407,942 | 1606 | MCPH1 | 8 | 6,407,982 |
| 1607 | MCPH1 | 8 | 6,414,463 | 1608 | MCPH1 | 8 | 6,480,594 |
| 1609 | ANGPT2 | 8 | 6,522,454 | 1610 | DLC1 | 8 | 13,033,085 |
| 1611 | SGCZ | 8 | 14,292,030 | 1612 | SGCZ | 8 | 14,297,725 |
| 1613 | SGCZ | 8 | 14,303,019 | 1614 | SGCZ | 8 | 14,567,685 |
| 1615 | SGCZ | 8 | 14,594,527 | 1616 | SGCZ | 8 | 14,594,583 |
| 1617 | SGCZ | 8 | 14,603,034 | 1618 | SGCZ | 8 | 14,619,388 |
| 1619 | SLC7A2 | 8 | 17,456,102 | 1620 | SLC7A2 | 8 | 17,480,172 |
| 1621 | PSD3 | 8 | 18,467,203 | 1622 | PSD3 | 8 | 18,469,732 |
| 1623 | PSD3 | 8 | 18,708,574 | 1624 | PSD3 | 8 | 18,709,420 |
| 1625 | PSD3 | 8 | 18,819,182 | 1626 | ATP6V1B2 | 8 | 20,110,329 |
| 1627 | ATP6V1B2 | 8 | 20,116,050 | 1628 | XPO7 | 8 | 21,934,553 |
| 1629 | PPP3CC | 8 | 22,390,555 | 1630 | PPP3CC | 8 | 22,391,033 |
| 1631 | PPP3CC | 8 | 22,416,883 | 1632 | PPP3CC | 8 | 22,417,197 |
| 1633 | PPP3CC | 8 | 22,421,890 | 1634 | PPP3CC | 8 | 22,438,725 |
| 1635 | PPP3CC | 8 | 22,451,254 | 1636 | PPP3CC | 8 | 22,451,454 |
| 1637 | PEBP4 | 8 | 22,872,629 | 1638 | SLC25A37 | 8 | 23,454,180 |
| 1639 | SLC25A37 | 8 | 23,479,642 | 1640 | SLC25A37 | 8 | 23,487,137 |
| 1641 | SLC25A37 | 8 | 23,490,677 | 1642 | UNC5D | 8 | 35,523,511 |
| 1643 | UNC5D | 8 | 35,531,300 | 1644 | UNC5D | 8 | 35,534,179 |
| 1645 | UNC5D | 8 | 35,534,272 | 1646 | UNC5D | 8 | 35,543,336 |
| 1647 | UNC5D | 8 | 35,855,073 | 1648 | UNC5D | 8 | 36,042,355 |
| 1649 | UNC5D | 8 | 36,055,367 | 1650 | SFRP1 | 8 | 41,221,920 |
| 1651 | SFRP1 | 8 | 41,238,711 | 1652 | SFRP1 | 8 | 41,254,926 |
| 1653 | PRKDC | 8 | 48,805,431 | 1654 | PRKDC | 8 | 49,014,881 |
| 1655 | SNTG1 | 8 | 50,990,529 | 1656 | SNTG1 | 8 | 50,990,561 |
| 1657 | SNTG1 | 8 | 50,996,988 | 1658 | SNTG1 | 8 | 51,010,187 |
| 1659 | SNTG1 | 8 | 51,028,383 | 1660 | SNTG1 | 8 | 51,035,846 |
| 1661 | SNTG1 | 8 | 51,042,787 | 1662 | SNTG1 | 8 | 51,049,706 |
| 1663 | SNTG1 | 8 | 51,054,533 | 1664 | SNTG1 | 8 | 51,058,990 |
| 1665 | SNTG1 | 8 | 51,082,766 | 1666 | SNTG1 | 8 | 51,102,449 |
| 1667 | SNTG1 | 8 | 51,173,297 | 1668 | SNTG1 | 8 | 51,234,295 |
| 1669 | SNTG1 | 8 | 51,235,510 | 1670 | SNTG1 | 8 | 51,320,466 |
| 1671 | SNTG1 | 8 | 51,527,844 | 1672 | SNTG1 | 8 | 51,542,530 |
| 1673 | LYN | 8 | 56,942,219 | 1674 | LYN | 8 | 57,038,773 |
| 1675 | LYN | 8 | 57,039,144 | 1676 | LYN | 8 | 57,039,314 |
| 1677 | LYN | 8 | 57,045,025 | 1678 | LYN | 8 | 57,068,622 |
| 1679 | TOX | 8 | 59,968,292 | 1680 | TOX | 8 | 60,006,808 |
| 1681 | NKAIN3 | 8 | 63,276,675 | 1682 | NKAIN3 | 8 | 63,524,869 |
| 1683 | NKAIN3 | 8 | 63,553,374 | 1684 | NKAIN3 | 8 | 63,555,581 |
| 1685 | NKAIN3 | 8 | 63,588,448 | 1686 | NKAIN3 | 8 | 63,644,314 |
| 1687 | NKAIN3 | 8 | 64,033,212 | 1688 | NKAIN3 | 8 | 64,033,505 |
| 1689 | DEPDC2 | 8 | 69,166,435 | 1690 | DEPDC2 | 8 | 69,176,632 |
| 1691 | DEPDC2 | 8 | 69,177,796 | 1692 | KCNB2 | 8 | 73,754,111 |
| 1693 | KCNB2 | 8 | 73,756,664 | 1694 | KCNB2 | 8 | 73,762,984 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1695 | KCNB2 | 8 | 73,771,914 | 1696 | KCNB2 | 8 | 73,776,211 |
| 1697 | KCNB2 | 8 | 73,780,154 | 1698 | KCNB2 | 8 | 73,783,806 |
| 1699 | KCNB2 | 8 | 73,798,241 | 1700 | KCNB2 | 8 | 73,799,263 |
| 1701 | KCNB2 | 8 | 73,811,601 | 1702 | KCNB2 | 8 | 73,818,016 |
| 1703 | KCNB2 | 8 | 73,901,806 | 1704 | KCNB2 | 8 | 73,905,902 |
| 1705 | KCNB2 | 8 | 73,906,242 | 1706 | KCNB2 | 8 | 73,906,305 |
| 1707 | KCNB2 | 8 | 74,001,540 | 1708 | KCNB2 | 8 | 74,006,869 |
| 1709 | MMP16 | 8 | 89,115,235 | 1710 | MMP16 | 8 | 89,379,684 |
| 1711 | MMP16 | 8 | 89,413,738 | 1712 | MMP16 | 8 | 89,414,303 |
| 1713 | MMP16 | 8 | 89,421,430 | 1714 | GRHL2 | 8 | 102,684,162 |
| 1715 | GRHL2 | 8 | 102,689,866 | 1716 | GRHL2 | 8 | 102,701,749 |
| 1717 | GRHL2 | 8 | 102,702,489 | 1718 | GRHL2 | 8 | 102,718,857 |
| 1719 | GRHL2 | 8 | 102,736,242 | 1720 | GRHL2 | 8 | 102,744,463 |
| 1721 | GRHL2 | 8 | 102,746,981 | 1722 | GRHL2 | 8 | 102,749,085 |
| 1723 | GRHL2 | 8 | 102,759,164 | 1724 | NCALD | 8 | 102,769,504 |
| 1725 | NCALD | 8 | 102,781,373 | 1726 | NCALD | 8 | 102,801,328 |
| 1727 | NCALD | 8 | 102,812,988 | 1728 | NCALD | 8 | 102,815,103 |
| 1729 | NCALD | 8 | 102,815,612 | 1730 | ZFPM2 | 8 | 106,488,701 |
| 1731 | ZFPM2 | 8 | 106,488,930 | 1732 | ZFPM2 | 8 | 106,489,004 |
| 1733 | ZFPM2 | 8 | 106,497,198 | 1734 | ZFPM2 | 8 | 106,499,852 |
| 1735 | ZFPM2 | 8 | 106,505,157 | 1736 | ZFPM2 | 8 | 106,507,154 |
| 1737 | ZFPM2 | 8 | 106,507,756 | 1738 | ZFPM2 | 8 | 106,521,287 |
| 1739 | ZFPM2 | 8 | 106,530,047 | 1740 | ZFPM2 | 8 | 106,688,431 |
| 1741 | ZFPM2 | 8 | 106,888,057 | 1742 | CSMD3 | 8 | 113,274,947 |
| 1743 | CSMD3 | 8 | 113,288,783 | 1744 | CSMD3 | 8 | 113,335,045 |
| 1745 | CSMD3 | 8 | 113,337,274 | 1746 | CSMD3 | 8 | 113,338,203 |
| 1747 | CSMD3 | 8 | 113,352,390 | 1748 | CSMD3 | 8 | 113,373,346 |
| 1749 | CSMD3 | 8 | 113,387,234 | 1750 | CSMD3 | 8 | 113,443,580 |
| 1751 | CSMD3 | 8 | 113,443,849 | 1752 | CSMD3 | 8 | 113,445,071 |
| 1753 | CSMD3 | 8 | 113,449,291 | 1754 | CSMD3 | 8 | 113,451,969 |
| 1755 | CSMD3 | 8 | 113,452,014 | 1756 | CSMD3 | 8 | 113,452,239 |
| 1757 | CSMD3 | 8 | 113,469,659 | 1758 | CSMD3 | 8 | 113,470,832 |
| 1759 | CSMD3 | 8 | 113,473,493 | 1760 | CSMD3 | 8 | 113,474,100 |
| 1761 | CSMD3 | 8 | 113,539,247 | 1762 | CSMD3 | 8 | 113,554,111 |
| 1763 | CSMD3 | 8 | 114,099,667 | 1764 | CSMD3 | 8 | 114,104,594 |
| 1765 | CSMD3 | 8 | 114,526,293 | 1766 | SAMD12 | 8 | 119,448,826 |
| 1767 | SAMD12 | 8 | 119,517,329 | 1768 | FBXO32 | 8 | 124,585,035 |
| 1769 | FER1L6 | 8 | 124,966,104 | 1770 | FER1L6 | 8 | 124,991,846 |
| 1771 | FER1L6 | 8 | 124,996,892 | 1772 | FER1L6 | 8 | 124,997,443 |
| 1773 | FER1L6 | 8 | 125,002,201 | 1774 | FER1L6 | 8 | 125,010,633 |
| 1775 | FER1L6 | 8 | 125,011,048 | 1776 | FER1L6 | 8 | 125,015,766 |
| 1777 | FER1L6 | 8 | 125,053,616 | 1778 | MTSS1 | 8 | 125,688,384 |
| 1779 | MTSS1 | 8 | 125,690,229 | 1780 | MTSS1 | 8 | 125,708,636 |
| 1781 | MTSS1 | 8 | 125,771,942 | 1782 | MTSS1 | 8 | 125,793,473 |
| 1783 | MTSS1 | 8 | 125,952,323 | 1784 | MTSS1 | 8 | 125,954,015 |
| 1785 | DDEF1 | 8 | 131,325,860 | 1786 | ADCY8 | 8 | 132,056,557 |
| 1787 | ADCY8 | 8 | 132,057,744 | 1788 | ADCY8 | 8 | 132,057,791 |
| 1789 | COL22A1 | 8 | 139,662,848 | 1790 | COL22A1 | 8 | 139,662,978 |
| 1791 | COL22A1 | 8 | 139,743,805 | 1792 | COL22A1 | 8 | 139,888,333 |
| 1793 | COL22A1 | 8 | 139,890,241 | 1794 | COL22A1 | 8 | 139,892,274 |
| 1795 | COL22A1 | 8 | 139,892,385 | 1796 | COL22A1 | 8 | 139,895,678 |
| 1797 | COL22A1 | 8 | 139,908,094 | 1798 | COL22A1 | 8 | 139,972,905 |
| 1799 | COL22A1 | 8 | 139,975,270 | 1800 | COL22A1 | 8 | 139,976,026 |
| 1801 | KCNK9 | 8 | 140,740,112 | 1802 | PTP4A3 | 8 | 142,469,282 |
| 1803 | SMARCA2 | 9 | 2,063,292 | 1804 | SMARCA2 | 9 | 2,084,908 |
| 1805 | SMARCA2 | 9 | 2,113,639 | 1806 | SMARCA2 | 9 | 2,118,165 |
| 1807 | SMARCA2 | 9 | 2,170,694 | 1808 | SMARCA2 | 9 | 2,176,460 |
| 1809 | SMARCA2 | 9 | 2,181,725 | 1810 | SLC1A1 | 9 | 4,452,265 |
| 1811 | SLC1A1 | 9 | 4,483,526 | 1812 | SLC1A1 | 9 | 4,572,082 |
| 1813 | SLC1A1 | 9 | 4,588,748 | 1814 | PTPRD | 9 | 8,415,422 |
| 1815 | ADAMTSL1 | 9 | 18,718,689 | 1816 | ASAH3L | 9 | 19,438,473 |
| 1817 | KIAA1797 | 9 | 20,682,438 | 1818 | KIAA1797 | 9 | 20,686,043 |
| 1819 | KIAA1797 | 9 | 20,725,284 | 1820 | KIAA1797 | 9 | 20,730,433 |
| 1821 | KIAA1797 | 9 | 20,732,210 | 1822 | KIAA1797 | 9 | 20,753,840 |
| 1823 | KIAA1797 | 9 | 20,754,870 | 1824 | KIAA1797 | 9 | 20,833,841 |
| 1825 | KIAA1797 | 9 | 20,872,525 | 1826 | KIAA1797 | 9 | 20,873,199 |
| 1827 | KIAA1797 | 9 | 20,873,713 | 1828 | KIAA1797 | 9 | 20,882,952 |
| 1829 | KIAA1797 | 9 | 20,989,646 | 1830 | IFT74 | 9 | 26,935,976 |
| 1831 | IFT74 | 9 | 26,936,249 | 1832 | IFT74 | 9 | 26,999,738 |
| 1833 | IFT74 | 9 | 27,022,385 | 1834 | IFT74 | 9 | 27,031,676 |
| 1835 | IFT74 | 9 | 27,056,070 | 1836 | IFT74 | 9 | 27,063,650 |
| 1837 | TEK | 9 | 27,065,883 | 1838 | TEK | 9 | 27,142,292 |
| 1839 | PIP5K1B | 9 | 70,643,121 | 1840 | PIP5K1B | 9 | 70,647,996 |
| 1841 | PIP5K1B | 9 | 70,673,848 | 1842 | PIP5K1B | 9 | 70,687,329 |
| 1843 | PIP5K1B | 9 | 70,691,508 | 1844 | PIP5K1B | 9 | 70,700,570 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1845 | PIP5K1B | 9 | 70,814,515 | 1846 | MAMDC2 | 9 | 71,887,859 |
| 1847 | MAMDC2 | 9 | 71,896,167 | 1848 | MAMDC2 | 9 | 71,913,927 |
| 1849 | MAMDC2 | 9 | 71,917,647 | 1850 | MAMDC2 | 9 | 71,998,782 |
| 1851 | TRPM3 | 9 | 72,637,875 | 1852 | TRPM3 | 9 | 72,644,103 |
| 1853 | TRPM3 | 9 | 72,648,924 | 1854 | TRPM3 | 9 | 72,649,911 |
| 1855 | TRPM3 | 9 | 72,652,604 | 1856 | TRPM3 | 9 | 72,662,180 |
| 1857 | TMC1 | 9 | 74,317,350 | 1858 | TMC1 | 9 | 74,317,363 |
| 1859 | TMC1 | 9 | 74,317,668 | 1860 | TMC1 | 9 | 74,320,797 |
| 1861 | TMC1 | 9 | 74,401,423 | 1862 | TMC1 | 9 | 74,503,133 |
| 1863 | TMC1 | 9 | 74,507,002 | 1864 | TMC1 | 9 | 74,507,694 |
| 1865 | TMC1 | 9 | 74,531,851 | 1866 | TMC1 | 9 | 74,537,387 |
| 1867 | TMC1 | 9 | 74,610,051 | 1868 | TMC1 | 9 | 74,686,641 |
| 1869 | TRPM6 | 9 | 76,540,404 | 1870 | TRPM6 | 9 | 76,543,120 |
| 1871 | TRPM6 | 9 | 76,566,467 | 1872 | TRPM6 | 9 | 76,567,230 |
| 1873 | TRPM6 | 9 | 76,570,941 | 1874 | GNAQ | 9 | 79,481,827 |
| 1875 | GNAQ | 9 | 79,483,477 | 1876 | GNAQ | 9 | 79,494,080 |
| 1877 | GNAQ | 9 | 79,517,988 | 1878 | GNAQ | 9 | 79,536,340 |
| 1879 | GNAQ | 9 | 79,827,513 | 1880 | GNAQ | 9 | 79,845,641 |
| 1881 | GNAQ | 9 | 79,868,777 | 1882 | GNAQ | 9 | 79,874,660 |
| 1883 | GNAQ | 9 | 79,878,161 | 1884 | NTRK2 | 9 | 86,457,519 |
| 1885 | NTRK2 | 9 | 86,464,568 | 1886 | NTRK2 | 9 | 86,472,347 |
| 1887 | NTRK2 | 9 | 86,479,100 | 1888 | NTRK2 | 9 | 86,542,608 |
| 1889 | NTRK2 | 9 | 86,553,021 | 1890 | NTRK2 | 9 | 86,571,296 |
| 1891 | NTRK2 | 9 | 86,573,597 | 1892 | NTRK2 | 9 | 86,577,727 |
| 1893 | NTRK2 | 9 | 86,579,987 | 1894 | NTRK2 | 9 | 86,598,770 |
| 1895 | NTRK2 | 9 | 86,598,798 | 1896 | NTRK2 | 9 | 86,625,557 |
| 1897 | NTRK2 | 9 | 86,631,295 | 1898 | NTRK2 | 9 | 86,635,476 |
| 1899 | DAPK1 | 9 | 89,446,457 | 1900 | DAPK1 | 9 | 89,466,486 |
| 1901 | DAPK1 | 9 | 89,518,960 | 1902 | SHC3 | 9 | 90,813,631 |
| 1903 | SHC3 | 9 | 90,829,608 | 1904 | SHC3 | 9 | 90,846,224 |
| 1905 | DIRAS2 | 9 | 92,391,092 | 1906 | DIRAS2 | 9 | 92,432,152 |
| 1907 | DIRAS2 | 9 | 92,432,978 | 1908 | DIRAS2 | 9 | 92,453,078 |
| 1909 | NFIL3 | 9 | 93,283,388 | 1910 | ZNF169 | 9 | 96,065,119 |
| 1911 | GABBR2 | 9 | 100,075,165 | 1912 | GABBR2 | 9 | 100,094,975 |
| 1913 | GABBR2 | 9 | 100,101,460 | 1914 | GABBR2 | 9 | 100,102,891 |
| 1915 | GRIN3A | 9 | 103,379,633 | 1916 | GRIN3A | 9 | 103,429,073 |
| 1917 | GRIN3A | 9 | 103,440,380 | 1918 | GRIN3A | 9 | 103,457,375 |
| 1919 | GRIN3A | 9 | 103,467,085 | 1920 | GRIN3A | 9 | 103,467,403 |
| 1921 | GRIN3A | 9 | 103,468,661 | 1922 | GRIN3A | 9 | 103,476,464 |
| 1923 | GRIN3A | 9 | 103,481,593 | 1924 | GRIN3A | 9 | 103,491,159 |
| 1925 | GRIN3A | 9 | 103,516,083 | 1926 | GRIN3A | 9 | 103,520,656 |
| 1927 | GRIN3A | 9 | 103,535,011 | 1928 | GRIN3A | 9 | 103,578,372 |
| 1929 | FKTN | 9 | 107,361,938 | 1930 | FKTN | 9 | 107,409,195 |
| 1931 | FKTN | 9 | 107,435,753 | 1932 | PALM2 | 9 | 111,481,826 |
| 1933 | PALM2 | 9 | 111,488,202 | 1934 | PALM2 | 9 | 111,560,947 |
| 1935 | PALM2 | 9 | 111,561,356 | 1936 | PALM2 | 9 | 111,561,384 |
| 1937 | PALM2 | 9 | 111,975,567 | 1938 | SVEP1Â | 9 | 112,294,525 |
| 1939 | SVEP1Â | 9 | 112,396,284 | 1940 | MUSK | 9 | 112,443,667 |
| 1941 | MUSK | 9 | 112,562,853 | 1942 | MUSK | 9 | 112,600,135 |
| 1943 | MUSK | 9 | 112,615,167 | 1944 | RGS3 | 9 | 115,354,739 |
| 1945 | RGS3 | 9 | 115,368,771 | 1946 | ZNF618 | 9 | 115,840,427 |
| 1947 | DFNB31 | 9 | 116,203,827 | 1948 | DFNB31 | 9 | 116,210,131 |
| 1949 | DFNB31 | 9 | 116,216,770 | 1950 | DFNB31 | 9 | 116,219,043 |
| 1951 | DFNB31 | 9 | 116,221,058 | 1952 | DFNB31 | 9 | 116,222,299 |
| 1953 | DFNB31 | 9 | 116,222,970 | 1954 | DFNB31 | 9 | 116,229,014 |
| 1955 | DFNB31 | 9 | 116,250,139 | 1956 | DFNB31 | 9 | 116,287,408 |
| 1957 | DFNB31 | 9 | 116,290,214 | 1958 | DFNB31 | 9 | 116,312,260 |
| 1959 | DFNB31 | 9 | 116,327,990 | 1960 | DFNB31 | 9 | 116,345,761 |
| 1961 | PAPPA | 9 | 118,151,091 | 1962 | PAPPA | 9 | 118,185,562 |
| 1963 | PAPPA | 9 | 118,198,635 | 1964 | PAPPA | 9 | 118,211,325 |
| 1965 | ASTN2 | 9 | 118,293,293 | 1966 | ASTN2 | 9 | 118,298,008 |
| 1967 | ASTN2 | 9 | 118,300,987 | 1968 | ASTN2 | 9 | 118,342,138 |
| 1969 | ASTN2 | 9 | 118,421,106 | 1970 | ASTN2 | 9 | 118,443,189 |
| 1971 | ASTN2 | 9 | 118,446,482 | 1972 | ASTN2 | 9 | 118,449,459 |
| 1973 | ASTN2 | 9 | 118,450,577 | 1974 | ASTN2 | 9 | 118,493,276 |
| 1975 | ASTN2 | 9 | 118,514,893 | 1976 | ASTN2 | 9 | 118,750,592 |
| 1977 | ASTN2 | 9 | 118,752,154 | 1978 | ASTN2 | 9 | 118,767,325 |
| 1979 | ASTN2 | 9 | 118,767,524 | 1980 | ASTN2 | 9 | 118,780,289 |
| 1981 | ASTN2 | 9 | 118,782,752 | 1982 | ASTN2 | 9 | 118,783,350 |
| 1983 | ASTN2 | 9 | 118,786,221 | 1984 | ASTN2 | 9 | 118,898,790 |
| 1985 | ASTN2 | 9 | 118,900,774 | 1986 | ASTN2 | 9 | 119,192,376 |
| 1987 | ASTN2 | 9 | 119,198,404 | 1988 | ASTN2 | 9 | 119,233,626 |
| 1989 | CDK5RAP2 | 9 | 122,266,946 | 1990 | CDK5RAP2 | 9 | 122,315,206 |
| 1991 | CDK5RAP2 | 9 | 122,377,819 | 1992 | RAB14 | 9 | 122,976,150 |
| 1993 | GSN | 9 | 123,122,996 | 1994 | GSN | 9 | 123,123,769 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 1995 | GSN | 9 | 123,135,092 | 1996 | GSN | 9 | 123,138,356 |
| 1997 | TTLL11 | 9 | 123,780,890 | 1998 | TTLL11 | 9 | 123,839,061 |
| 1999 | TTLL11 | 9 | 123,904,206 | 2000 | TTLL11 | 9 | 123,908,883 |
| 2001 | LHX6 | 9 | 123,995,743 | 2002 | DENND1A | 9 | 125,236,746 |
| 2003 | DENND1A | 9 | 125,237,968 | 2004 | DENND1A | 9 | 125,259,527 |
| 2005 | DENND1A | 9 | 125,273,650 | 2006 | DENND1A | 9 | 125,274,235 |
| 2007 | DENND1A | 9 | 125,278,391 | 2008 | DENND1A | 9 | 125,391,244 |
| 2009 | DENND1A | 9 | 125,406,711 | 2010 | DENND1A | 9 | 125,457,338 |
| 2011 | DENND1A | 9 | 125,677,182 | 2012 | DENND1A | 9 | 125,701,433 |
| 2013 | DENND1A | 9 | 125,714,335 | 2014 | NEK6 | 9 | 126,050,083 |
| 2015 | NEK6 | 9 | 126,050,327 | 2016 | NEK6 | 9 | 126,050,695 |
| 2017 | NEK6 | 9 | 126,129,943 | 2018 | ABL1 | 9 | 132,590,178 |
| 2019 | ABL1 | 9 | 132,601,560 | 2020 | ABL1 | 9 | 132,603,386 |
| 2021 | ABL1 | 9 | 132,607,062 | 2022 | ABL1 | 9 | 132,610,819 |
| 2023 | ABL1 | 9 | 132,611,325 | 2024 | ABL1 | 9 | 132,611,594 |
| 2025 | ABL1 | 9 | 132,613,270 | 2026 | ABL1 | 9 | 132,625,367 |
| 2027 | ABL1 | 9 | 132,690,607 | 2028 | TSC1 | 9 | 134,739,894 |
| 2029 | TSC1 | 9 | 134,765,855 | 2030 | TSC1 | 9 | 134,773,990 |
| 2031 | TSC1 | 9 | 134,802,822 | 2032 | VAV2 | 9 | 135,614,363 |
| 2033 | VAV2 | 9 | 135,655,129 | 2034 | VAV2 | 9 | 135,722,588 |
| 2035 | VAV2 | 9 | 135,725,041 | 2036 | VAV2 | 9 | 135,726,939 |
| 2037 | VAV2 | 9 | 135,737,060 | 2038 | KCNT1 | 9 | 137,739,699 |
| 2039 | INPP5E | 9 | 138,461,433 | 2040 | NOTCH1 | 9 | 138,521,325 |
| 2041 | NOTCH1 | 9 | 138,546,887 | 2042 | CACNA1B | 9 | 140,019,421 |
| 2043 | CACNA1B | 9 | 140,019,503 | 2044 | CACNA1B | 9 | 140,031,491 |
| 2045 | CACNA1B | 9 | 140,040,905 | 2046 | CACNA1B | 9 | 140,106,414 |
| 2047 | CACNA1B | 9 | 140,131,345 | 2048 | PITRM1 | 10 | 3,163,364 |
| 2049 | PITRM1 | 10 | 3,173,747 | 2050 | PRKCQ | 10 | 7,132,955 |
| 2051 | CACNB2 | 10 | 18,589,647 | 2052 | CACNB2 | 10 | 18,751,294 |
| 2053 | CACNB2 | 10 | 18,819,330 | 2054 | CACNB2 | 10 | 18,829,273 |
| 2055 | CACNB2 | 10 | 18,830,509 | 2056 | CACNB2 | 10 | 18,830,733 |
| 2057 | CACNB2 | 10 | 18,838,209 | 2058 | CACNB2 | 10 | 18,839,230 |
| 2059 | CACNB2 | 10 | 18,839,896 | 2060 | CACNB2 | 10 | 18,847,063 |
| 2061 | CACNB2 | 10 | 18,861,080 | 2062 | CACNB2 | 10 | 18,862,348 |
| 2063 | ARMC3 | 10 | 23,233,970 | 2064 | ARMC3 | 10 | 23,277,574 |
| 2065 | ARMC3 | 10 | 23,314,154 | 2066 | MYO3A | 10 | 26,222,334 |
| 2067 | MYO3A | 10 | 26,256,474 | 2068 | MYO3A | 10 | 26,352,830 |
| 2069 | MYO3A | 10 | 26,353,343 | 2070 | MYO3A | 10 | 26,383,203 |
| 2071 | MYO3A | 10 | 26,385,264 | 2072 | MYO3A | 10 | 26,419,059 |
| 2073 | MYO3A | 10 | 26,447,414 | 2074 | MYO3A | 10 | 26,493,174 |
| 2075 | MYO3A | 10 | 26,504,528 | 2076 | SLC18A3 | 10 | 50,438,238 |
| 2077 | SLC18A3 | 10 | 50,491,249 | 2078 | PRKG1 | 10 | 52,459,361 |
| 2079 | PRKG1 | 10 | 52,577,528 | 2080 | PRKG1 | 10 | 52,585,849 |
| 2081 | PRKG1 | 10 | 52,585,942 | 2082 | PRKG1 | 10 | 52,586,179 |
| 2083 | PRKG1 | 10 | 52,619,168 | 2084 | PRKG1 | 10 | 52,869,416 |
| 2085 | PRKG1 | 10 | 52,901,690 | 2086 | PRKG1 | 10 | 52,904,054 |
| 2087 | PRKG1 | 10 | 53,550,571 | 2088 | PRKG1 | 10 | 53,562,357 |
| 2089 | PCDH15 | 10 | 55,284,858 | 2090 | PCDH15 | 10 | 55,334,011 |
| 2091 | PCDH15 | 10 | 55,468,894 | 2092 | PCDH15 | 10 | 55,502,506 |
| 2093 | PCDH15 | 10 | 55,631,926 | 2094 | PCDH15 | 10 | 55,633,952 |
| 2095 | PCDH15 | 10 | 55,635,312 | 2096 | PCDH15 | 10 | 55,636,727 |
| 2097 | PCDH15 | 10 | 55,639,211 | 2098 | PCDH15 | 10 | 55,639,890 |
| 2099 | PCDH15 | 10 | 55,639,938 | 2100 | PCDH15 | 10 | 55,709,225 |
| 2101 | PCDH15 | 10 | 55,743,087 | 2102 | PCDH15 | 10 | 55,746,766 |
| 2103 | PCDH15 | 10 | 55,759,269 | 2104 | PCDH15 | 10 | 55,806,859 |
| 2105 | PCDH15 | 10 | 55,817,364 | 2106 | PCDH15 | 10 | 56,237,672 |
| 2107 | PCDH15 | 10 | 56,285,230 | 2108 | PCDH15 | 10 | 56,287,963 |
| 2109 | PCDH15 | 10 | 56,288,058 | 2110 | PCDH15 | 10 | 56,873,024 |
| 2111 | PCDH15 | 10 | 56,960,734 | 2112 | PCDH15 | 10 | 57,003,485 |
| 2113 | PCDH15 | 10 | 57,005,770 | 2114 | ANK3 | 10 | 61,466,096 |
| 2115 | ANK3 | 10 | 61,490,495 | 2116 | ANK3 | 10 | 61,569,339 |
| 2117 | ANK3 | 10 | 61,585,961 | 2118 | ANK3 | 10 | 61,594,867 |
| 2119 | ANK3 | 10 | 61,740,656 | 2120 | ANK3 | 10 | 61,746,842 |
| 2121 | JMJD1C | 10 | 64,618,690 | 2122 | JMJD1C | 10 | 64,732,014 |
| 2123 | JMJD1C | 10 | 64,736,192 | 2124 | JMJD1C | 10 | 64,761,165 |
| 2125 | JMJD1C | 10 | 64,771,213 | 2126 | JMJD1C | 10 | 64,778,162 |
| 2127 | CTNNA3 | 10 | 67,462,579 | 2128 | CTNNA3 | 10 | 67,487,829 |
| 2129 | CTNNA3 | 10 | 67,515,886 | 2130 | CTNNA3 | 10 | 67,516,561 |
| 2131 | CTNNA3 | 10 | 67,564,825 | 2132 | CTNNA3 | 10 | 67,577,247 |
| 2133 | CTNNA3 | 10 | 67,595,330 | 2134 | CTNNA3 | 10 | 67,634,469 |
| 2135 | CTNNA3 | 10 | 67,637,097 | 2136 | CTNNA3 | 10 | 67,695,250 |
| 2137 | CTNNA3 | 10 | 67,698,152 | 2138 | CTNNA3 | 10 | 67,713,848 |
| 2139 | CTNNA3 | 10 | 67,725,533 | 2140 | CTNNA3 | 10 | 68,131,872 |
| 2141 | CTNNA3 | 10 | 68,283,754 | 2142 | CTNNA3 | 10 | 68,283,801 |
| 2143 | CTNNA3 | 10 | 68,285,636 | 2144 | CTNNA3 | 10 | 68,506,311 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 2145 | CTNNA3 | 10 | 68,600,561 | 2146 | CTNNA3 | 10 | 68,609,647 |
| 2147 | CTNNA3 | 10 | 68,611,041 | 2148 | CTNNA3 | 10 | 68,617,000 |
| 2149 | CTNNA3 | 10 | 68,622,864 | 2150 | CTNNA3 | 10 | 68,626,505 |
| 2151 | CTNNA3 | 10 | 68,628,119 | 2152 | CTNNA3 | 10 | 68,628,572 |
| 2153 | CTNNA3 | 10 | 68,631,498 | 2154 | CTNNA3 | 10 | 68,742,873 |
| 2155 | CTNNA3 | 10 | 68,750,082 | 2156 | CTNNA3 | 10 | 69,048,122 |
| 2157 | CTNNA3 | 10 | 69,088,276 | 2158 | CTNNA3 | 10 | 69,106,914 |
| 2159 | CTNNA3 | 10 | 69,118,295 | 2160 | CTNNA3 | 10 | 69,123,347 |
| 2161 | CTNNA3 | 10 | 69,163,784 | 2162 | CTNNA3 | 10 | 69,193,368 |
| 2163 | CDH23 | 10 | 73,076,605 | 2164 | KCNMA1 | 10 | 78,232,825 |
| 2165 | KCNMA1 | 10 | 78,258,751 | 2166 | KCNMA1 | 10 | 78,259,743 |
| 2167 | KCNMA1 | 10 | 78,286,204 | 2168 | KCNMA1 | 10 | 78,297,136 |
| 2169 | KCNMA1 | 10 | 78,299,801 | 2170 | KCNMA1 | 10 | 78,300,503 |
| 2171 | KCNMA1 | 10 | 78,358,158 | 2172 | KCNMA1 | 10 | 78,372,877 |
| 2173 | KCNMA1 | 10 | 78,426,444 | 2174 | KCNMA1 | 10 | 78,426,609 |
| 2175 | KCNMA1 | 10 | 78,446,565 | 2176 | KCNMA1 | 10 | 78,447,710 |
| 2177 | KCNMA1 | 10 | 78,587,494 | 2178 | KCNMA1 | 10 | 78,598,169 |
| 2179 | KCNMA1 | 10 | 78,865,698 | 2180 | KCNMA1 | 10 | 78,865,774 |
| 2181 | KCNMA1 | 10 | 78,872,456 | 2182 | KCNMA1 | 10 | 79,086,473 |
| 2183 | NRG3 | 10 | 83,532,551 | 2184 | NRG3 | 10 | 83,626,423 |
| 2185 | NRG3 | 10 | 84,141,992 | 2186 | NRG3 | 10 | 84,195,058 |
| 2187 | NRG3 | 10 | 84,604,364 | 2188 | NRG3 | 10 | 84,616,939 |
| 2189 | SORBS1 | 10 | 97,061,998 | 2190 | SORBS1 | 10 | 97,097,088 |
| 2191 | SORBS1 | 10 | 97,111,958 | 2192 | SORBS1 | 10 | 97,112,231 |
| 2193 | SORBS1 | 10 | 97,136,438 | 2194 | SORBS1 | 10 | 97,214,150 |
| 2195 | SORBS1 | 10 | 97,313,525 | 2196 | PIK3AP1 | 10 | 98,343,203 |
| 2197 | PIK3AP1 | 10 | 98,361,738 | 2198 | PIK3AP1 | 10 | 98,368,240 |
| 2199 | PIK3AP1 | 10 | 98,370,534 | 2200 | PIK3AP1 | 10 | 98,468,439 |
| 2201 | SLIT1 | 10 | 98,840,790 | 2202 | SLIT1 | 10 | 98,868,371 |
| 2203 | SLIT1 | 10 | 98,923,843 | 2204 | SLIT1 | 10 | 98,956,872 |
| 2205 | SLIT1 | 10 | 98,961,015 | 2206 | SORCS3 | 10 | 106,355,057 |
| 2207 | SORCS3 | 10 | 106,371,034 | 2208 | SORCS3 | 10 | 106,511,862 |
| 2209 | SORCS3 | 10 | 106,518,456 | 2210 | SORCS3 | 10 | 106,543,829 |
| 2211 | SORCS3 | 10 | 106,546,794 | 2212 | SORCS3 | 10 | 106,586,272 |
| 2213 | SORCS3 | 10 | 106,618,988 | 2214 | SORCS3 | 10 | 106,622,111 |
| 2215 | SORCS3 | 10 | 106,703,623 | 2216 | SORCS3 | 10 | 106,934,094 |
| 2217 | SORCS3 | 10 | 107,025,958 | 2218 | VTI1A | 10 | 114,226,855 |
| 2219 | VTI1A | 10 | 114,228,361 | 2220 | ATRNL1 | 10 | 116,937,138 |
| 2221 | ATRNL1 | 10 | 117,018,254 | 2222 | ATRNL1 | 10 | 117,193,379 |
| 2223 | ATRNL1 | 10 | 117,251,493 | 2224 | ATRNL1 | 10 | 117,257,300 |
| 2225 | ATRNL1 | 10 | 117,261,885 | 2226 | ATRNL1 | 10 | 117,267,663 |
| 2227 | ATRNL1 | 10 | 117,280,076 | 2228 | ATRNL1 | 10 | 117,301,088 |
| 2229 | ATRNL1 | 10 | 117,305,474 | 2230 | ATRNL1 | 10 | 117,329,513 |
| 2231 | ATRNL1 | 10 | 117,341,209 | 2232 | ATRNL1 | 10 | 117,341,891 |
| 2233 | ATRNL1 | 10 | 117,342,514 | 2234 | ATRNL1 | 10 | 117,348,909 |
| 2235 | ATRNL1 | 10 | 117,348,932 | 2236 | ATRNL1 | 10 | 117,350,294 |
| 2237 | ATRNL1 | 10 | 117,352,824 | 2238 | ATRNL1 | 10 | 117,385,627 |
| 2239 | ATRNL1 | 10 | 117,404,353 | 2240 | ATRNL1 | 10 | 117,628,480 |
| 2241 | HSPA12A | 10 | 118,434,753 | 2242 | HSPA12A | 10 | 118,437,365 |
| 2243 | HSPA12A | 10 | 118,438,068 | 2244 | NANOS1 | 10 | 120,811,615 |
| 2245 | GRK5 | 10 | 121,222,444 | 2246 | ATE1 | 10 | 123,421,505 |
| 2247 | ATE1 | 10 | 123,426,686 | 2248 | ATE1 | 10 | 123,427,197 |
| 2249 | ATE1 | 10 | 123,427,443 | 2250 | ATE1 | 10 | 123,428,103 |
| 2251 | ATE1 | 10 | 123,432,831 | 2252 | ATE1 | 10 | 123,453,723 |
| 2253 | ATE1 | 10 | 123,484,634 | 2254 | ATE1 | 10 | 123,573,965 |
| 2255 | ATE1 | 10 | 123,614,295 | 2256 | ATE1 | 10 | 123,615,180 |
| 2257 | ATE1 | 10 | 123,627,690 | 2258 | ATE1 | 10 | 123,630,511 |
| 2259 | ATE1 | 10 | 123,634,335 | 2260 | ATE1 | 10 | 123,648,119 |
| 2261 | ATE1 | 10 | 123,659,245 | 2262 | ATE1 | 10 | 123,666,737 |
| 2263 | ATE1 | 10 | 123,669,674 | 2264 | EBF3 | 10 | 131,490,856 |
| 2265 | EBF3 | 10 | 131,645,661 | 2266 | EBF3 | 10 | 131,740,881 |
| 2267 | DEAF1 | 11 | 723,609 | 2268 | CEND1 | 11 | 762,982 |
| 2269 | CEND1 | 11 | 830,034 | 2270 | HCCA2 | 11 | 1,451,351 |
| 2271 | HCCA2 | 11 | 1,455,660 | 2272 | HCCA2 | 11 | 1,476,557 |
| 2273 | HCCA2 | 11 | 1,489,585 | 2274 | DUSP8 | 11 | 1,494,093 |
| 2275 | DUSP8 | 11 | 1,501,758 | 2276 | DUSP8 | 11 | 1,501,827 |
| 2277 | DUSP8 | 11 | 1,563,922 | 2278 | STIM1 | 11 | 3,931,164 |
| 2279 | TRIM21 | 11 | 4,352,761 | 2280 | TRIM21 | 11 | 4,365,143 |
| 2281 | GALNTL4 | 11 | 11,215,705 | 2282 | GALNTL4 | 11 | 11,219,194 |
| 2283 | GALNTL4 | 11 | 11,310,922 | 2284 | GALNTL4 | 11 | 11,591,325 |
| 2285 | GALNTL4 | 11 | 11,611,548 | 2286 | MICAL2 | 11 | 12,148,237 |
| 2287 | MICAL2 | 11 | 12,165,670 | 2288 | MICAL2 | 11 | 12,172,022 |
| 2289 | MICAL2 | 11 | 12,179,624 | 2290 | MICAL2 | 11 | 12,187,248 |
| 2291 | SPON1 | 11 | 13,978,590 | 2292 | SPON1 | 11 | 13,991,391 |
| 2293 | SPON1 | 11 | 13,992,156 | 2294 | SPON1 | 11 | 13,992,537 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 2295 | SPON1 | 11 | 13,994,054 | 2296 | SPON1 | 11 | 13,995,954 |
| 2297 | SPON1 | 11 | 14,004,879 | 2298 | SPON1 | 11 | 14,005,230 |
| 2299 | SPON1 | 11 | 14,005,260 | 2300 | SPON1 | 11 | 14,005,745 |
| 2301 | SPON1 | 11 | 14,008,775 | 2302 | SPON1 | 11 | 14,014,762 |
| 2303 | SPON1 | 11 | 14,014,854 | 2304 | SPON1 | 11 | 14,031,836 |
| 2305 | SPON1 | 11 | 14,039,110 | 2306 | SPON1 | 11 | 14,043,034 |
| 2307 | SPON1 | 11 | 14,070,335 | 2308 | SPON1 | 11 | 14,075,677 |
| 2309 | SPON1 | 11 | 14,213,020 | 2310 | SPON1 | 11 | 14,215,231 |
| 2311 | SPON1 | 11 | 14,221,555 | 2312 | SPON1 | 11 | 14,233,507 |
| 2313 | SPON1 | 11 | 14,248,953 | 2314 | USH1C | 11 | 17,470,828 |
| 2315 | USH1C | 11 | 17,472,244 | 2316 | USH1C | 11 | 17,475,101 |
| 2317 | USH1C | 11 | 17,499,779 | 2318 | OTOG | 11 | 17,615,741 |
| 2319 | SERGEF | 11 | 17,761,574 | 2320 | SERGEF | 11 | 17,767,536 |
| 2321 | SERGEF | 11 | 17,772,558 | 2322 | IGSF22 | 11 | 18,643,492 |
| 2323 | IGSF22 | 11 | 18,646,229 | 2324 | IGSF22 | 11 | 18,646,965 |
| 2325 | IGSF22 | 11 | 18,689,422 | 2326 | PTPN5 | 11 | 18,732,258 |
| 2327 | PTPN5 | 11 | 18,732,276 | 2328 | PTPN5 | 11 | 18,732,907 |
| 2329 | PTPN5 | 11 | 18,761,510 | 2330 | NAV2 | 11 | 19,700,849 |
| 2331 | NAV2 | 11 | 19,707,031 | 2332 | NAV2 | 11 | 19,707,122 |
| 2333 | NAV2 | 11 | 19,713,624 | 2334 | NAV2 | 11 | 19,724,190 |
| 2335 | NAV2 | 11 | 19,727,563 | 2336 | NAV2 | 11 | 19,732,967 |
| 2337 | NAV2 | 11 | 19,733,236 | 2338 | NAV2 | 11 | 19,743,216 |
| 2339 | NAV2 | 11 | 19,916,723 | 2340 | NAV2 | 11 | 20,071,925 |
| 2341 | NAV2 | 11 | 20,077,485 | 2342 | NAV2 | 11 | 20,077,810 |
| 2343 | NAV2 | 11 | 20,078,033 | 2344 | NAV2 | 11 | 20,078,168 |
| 2345 | SLC6A5 | 11 | 20,579,618 | 2346 | SLC6A5 | 11 | 20,597,598 |
| 2347 | SLC6A5 | 11 | 20,598,252 | 2348 | SLC6A5 | 11 | 20,599,698 |
| 2349 | SLC6A5 | 11 | 20,599,788 | 2350 | SLC6A5 | 11 | 20,601,656 |
| 2351 | SLC6A5 | 11 | 20,609,196 | 2352 | NELL1 | 11 | 20,763,894 |
| 2353 | KCNA4 | 11 | 29,964,590 | 2354 | KCNA4 | 11 | 29,983,650 |
| 2355 | KCNA4 | 11 | 29,984,859 | 2356 | KCNA4 | 11 | 29,987,012 |
| 2357 | LRRC4C | 11 | 40,094,119 | 2358 | LRRC4C | 11 | 40,098,953 |
| 2359 | LRRC4C | 11 | 40,131,206 | 2360 | LRRC4C | 11 | 40,149,430 |
| 2361 | LRRC4C | 11 | 40,149,688 | 2362 | LRRC4C | 11 | 40,194,755 |
| 2363 | LRRC4C | 11 | 40,198,084 | 2364 | LRRC4C | 11 | 40,209,366 |
| 2365 | LRRC4C | 11 | 40,211,317 | 2366 | LRRC4C | 11 | 40,212,327 |
| 2367 | LRRC4C | 11 | 40,216,303 | 2368 | LRRC4C | 11 | 40,216,724 |
| 2369 | LRRC4C | 11 | 40,217,071 | 2370 | LRRC4C | 11 | 40,229,850 |
| 2371 | LRRC4C | 11 | 40,231,418 | 2372 | LRRC4C | 11 | 40,231,636 |
| 2373 | LRRC4C | 11 | 40,262,733 | 2374 | LRRC4C | 11 | 40,306,179 |
| 2375 | LRRC4C | 11 | 40,359,450 | 2376 | PHACS | 11 | 44,050,194 |
| 2377 | PHACS | 11 | 44,050,992 | 2378 | PHACS | 11 | 44,057,118 |
| 2379 | PHACS | 11 | 44,057,694 | 2380 | PHACS | 11 | 44,058,383 |
| 2381 | PHACS | 11 | 44,062,444 | 2382 | PHACS | 11 | 44,067,266 |
| 2383 | SYT13 | 11 | 45,220,853 | 2384 | SYT13 | 11 | 45,226,820 |
| 2385 | SYT13 | 11 | 45,233,558 | 2386 | SYT13 | 11 | 45,234,779 |
| 2387 | SYT13 | 11 | 45,234,893 | 2388 | SYT13 | 11 | 45,242,661 |
| 2389 | SYT13 | 11 | 45,254,175 | 2390 | CTNND1 | 11 | 57,237,199 |
| 2391 | CTNND1 | 11 | 57,257,758 | 2392 | CTNND1 | 11 | 57,312,346 |
| 2393 | CTNND1 | 11 | 57,350,416 | 2394 | CTNND1 | 11 | 57,353,641 |
| 2395 | CTNND1 | 11 | 57,353,850 | 2396 | CTNND1 | 11 | 57,380,391 |
| 2397 | DLG2 | 11 | 82,852,684 | 2398 | DLG2 | 11 | 82,866,094 |
| 2399 | DLG2 | 11 | 82,881,713 | 2400 | DLG2 | 11 | 82,882,102 |
| 2401 | DLG2 | 11 | 82,910,180 | 2402 | DLG2 | 11 | 82,913,481 |
| 2403 | DLG2 | 11 | 82,935,775 | 2404 | DLG2 | 11 | 82,970,299 |
| 2405 | DLG2 | 11 | 82,982,760 | 2406 | DLG2 | 11 | 83,004,627 |
| 2407 | DLG2 | 11 | 83,018,046 | 2408 | DLG2 | 11 | 83,018,663 |
| 2409 | DLG2 | 11 | 83,018,964 | 2410 | DLG2 | 11 | 83,036,277 |
| 2411 | DLG2 | 11 | 83,065,789 | 2412 | DLG2 | 11 | 83,083,527 |
| 2413 | DLG2 | 11 | 83,086,000 | 2414 | DLG2 | 11 | 83,086,089 |
| 2415 | DLG2 | 11 | 83,098,203 | 2416 | DLG2 | 11 | 83,099,929 |
| 2417 | DLG2 | 11 | 83,120,827 | 2418 | DLG2 | 11 | 84,210,011 |
| 2419 | DLG2 | 11 | 84,254,292 | 2420 | DLG2 | 11 | 84,307,983 |
| 2421 | ELMOD1 | 11 | 107,036,969 | 2422 | OPCML | 11 | 131,716,323 |
| 2423 | OPCML | 11 | 131,904,482 | 2424 | OPCML | 11 | 132,032,722 |
| 2425 | OPCML | 11 | 132,037,815 | 2426 | OPCML | 11 | 132,624,713 |
| 2427 | OPCML | 11 | 132,795,217 | 2428 | OPCML | 11 | 132,905,489 |
| 2429 | OPCML | 11 | 133,105,149 | 2430 | WNT5B | 12 | 1,610,432 |
| 2431 | WNT5B | 12 | 1,611,877 | 2432 | TSPAN9 | 12 | 3,053,288 |
| 2433 | TSPAN9 | 12 | 3,173,346 | 2434 | TSPAN9 | 12 | 3,257,542 |
| 2435 | TSPAN9 | 12 | 3,258,265 | 2436 | TMEM16B | 12 | 5,755,581 |
| 2437 | TMEM16B | 12 | 5,760,697 | 2438 | TMEM16B | 12 | 5,776,400 |
| 2439 | TMEM16B | 12 | 5,781,725 | 2440 | TMEM16B | 12 | 5,786,611 |
| 2441 | TMEM16B | 12 | 5,793,628 | 2442 | TMEM16B | 12 | 5,794,409 |
| 2443 | STYK1 | 12 | 10,676,279 | 2444 | STYK1 | 12 | 10,696,179 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 2445 | STYK1 | 12 | 10,697,552 | 2446 | STYK1 | 12 | 10,697,609 |
| 2447 | STYK1 | 12 | 10,697,767 | 2448 | STYK1 | 12 | 10,711,189 |
| 2449 | LOC729025 | 12 | 16,235,442 | 2450 | LOC729025 | 12 | 16,236,620 |
| 2451 | LOC729025 | 12 | 16,237,633 | 2452 | LOC729025 | 12 | 16,237,876 |
| 2453 | LOC729025 | 12 | 16,288,678 | 2454 | LOC729025 | 12 | 16,297,957 |
| 2455 | LOC729025 | 12 | 16,298,403 | 2456 | LOC729025 | 12 | 16,302,981 |
| 2457 | LOC729025 | 12 | 16,310,672 | 2458 | PIK3C2G | 12 | 18,212,721 |
| 2459 | PIK3C2G | 12 | 18,349,706 | 2460 | PIK3C2G | 12 | 18,356,504 |
| 2461 | PIK3C2G | 12 | 18,393,150 | 2462 | PIK3C2G | 12 | 18,459,343 |
| 2463 | PIK3C2G | 12 | 18,506,439 | 2464 | PIK3C2G | 12 | 18,701,315 |
| 2465 | ITPR2 | 12 | 26,335,364 | 2466 | ITPR2 | 12 | 26,379,772 |
| 2467 | ITPR2 | 12 | 26,383,105 | 2468 | ITPR2 | 12 | 26,476,845 |
| 2469 | ITPR2 | 12 | 26,621,910 | 2470 | ITPR2 | 12 | 26,641,098 |
| 2471 | ITPR2 | 12 | 26,650,941 | 2472 | LRP1 | 12 | 55,844,772 |
| 2473 | LRP1 | 12 | 55,847,718 | 2474 | LRP1 | 12 | 55,878,824 |
| 2475 | LRP1 | 12 | 55,909,088 | 2476 | CNOT2 | 12 | 68,893,334 |
| 2477 | CNOT2 | 12 | 68,954,824 | 2478 | KCNC2 | 12 | 73,597,214 |
| 2479 | KCNC2 | 12 | 73,597,675 | 2480 | KCNC2 | 12 | 73,855,015 |
| 2481 | NAV3 | 12 | 77,041,541 | 2482 | NAV3 | 12 | 77,042,099 |
| 2483 | NAV3 | 12 | 77,070,387 | 2484 | GAS2L3 | 12 | 99,494,084 |
| 2485 | GAS2L3 | 12 | 99,494,793 | 2486 | GAS2L3 | 12 | 99,495,794 |
| 2487 | CHST11 | 12 | 103,575,899 | 2488 | CHST11 | 12 | 103,669,570 |
| 2489 | CHST11 | 12 | 103,676,521 | 2490 | CHST11 | 12 | 103,681,081 |
| 2491 | CHST11 | 12 | 103,685,709 | 2492 | CHST11 | 12 | 103,685,984 |
| 2493 | CHST11 | 12 | 103,692,809 | 2494 | CHST11 | 12 | 103,696,050 |
| 2495 | CHST11 | 12 | 103,702,696 | 2496 | CHST11 | 12 | 103,704,275 |
| 2497 | KIAA1853 | 12 | 118,035,761 | 2498 | KIAA1853 | 12 | 118,052,804 |
| 2499 | KIAA1853 | 12 | 118,053,104 | 2500 | KIAA1853 | 12 | 118,054,044 |
| 2501 | KIAA1853 | 12 | 118,054,167 | 2502 | KIAA1853 | 12 | 118,054,447 |
| 2503 | PLA2G1B | 12 | 119,247,148 | 2504 | RIMBP2 | 12 | 129,432,804 |
| 2505 | RIMBP2 | 12 | 129,433,601 | 2506 | RIMBP2 | 12 | 129,529,219 |
| 2507 | STX2 | 12 | 129,846,370 | 2508 | STX2 | 12 | 129,854,397 |
| 2509 | STX2 | 12 | 129,879,750 | 2510 | STX2 | 12 | 129,885,052 |
| 2511 | KIAA1545 | 12 | 131,667,713 | 2512 | KIAA1545 | 12 | 131,671,419 |
| 2513 | MTIF3 | 13 | 26,909,686 | 2514 | MTIF3 | 13 | 26,939,055 |
| 2515 | MTIF3 | 13 | 26,979,535 | 2516 | UBL3 | 13 | 29,235,331 |
| 2517 | N4BP2L2 | 13 | 31,897,951 | 2518 | N4BP2L2 | 13 | 31,934,759 |
| 2519 | N4BP2L2 | 13 | 31,953,620 | 2520 | NBEA | 13 | 34,550,806 |
| 2521 | NBEA | 13 | 34,773,125 | 2522 | NBEA | 13 | 34,784,368 |
| 2523 | NBEA | 13 | 34,796,208 | 2524 | NBEA | 13 | 34,827,043 |
| 2525 | NBEA | 13 | 34,952,510 | 2526 | NBEA | 13 | 34,980,142 |
| 2527 | NBEA | 13 | 35,070,686 | 2528 | TRPC4 | 13 | 37,108,100 |
| 2529 | TRPC4 | 13 | 37,203,414 | 2530 | TRPC4 | 13 | 37,212,640 |
| 2531 | TRPC4 | 13 | 37,243,920 | 2532 | TRPC4 | 13 | 37,282,014 |
| 2533 | KPNA3 | 13 | 49,167,094 | 2534 | KPNA3 | 13 | 49,231,388 |
| 2535 | KPNA3 | 13 | 49,279,103 | 2536 | KPNA3 | 13 | 49,341,559 |
| 2537 | PCDH17 | 13 | 56,739,785 | 2538 | PCDH17 | 13 | 57,113,143 |
| 2539 | PCDH17 | 13 | 57,113,277 | 2540 | PCDH17 | 13 | 57,124,943 |
| 2541 | PCDH17 | 13 | 57,130,775 | 2542 | PCDH20 | 13 | 60,868,943 |
| 2543 | PCDH20 | 13 | 60,932,538 | 2544 | PCDH20 | 13 | 60,964,632 |
| 2545 | LMO7 | 13 | 75,283,739 | 2546 | LMO7 | 13 | 75,308,726 |
| 2547 | SLAIN1 | 13 | 77,123,666 | 2548 | SLAIN1 | 13 | 77,130,842 |
| 2549 | SLAIN1 | 13 | 77,131,233 | 2550 | SLAIN1 | 13 | 77,159,020 |
| 2551 | SLAIN1 | 13 | 77,192,498 | 2552 | SLAIN1 | 13 | 77,192,550 |
| 2553 | SLAIN1 | 13 | 77,232,218 | 2554 | GPC5 | 13 | 90,781,911 |
| 2555 | GPC5 | 13 | 90,792,026 | 2556 | GPC5 | 13 | 90,811,414 |
| 2557 | GPC5 | 13 | 90,811,945 | 2558 | GPC5 | 13 | 90,813,978 |
| 2559 | GPC5 | 13 | 90,817,618 | 2560 | GPC5 | 13 | 90,818,043 |
| 2561 | GPC5 | 13 | 92,100,968 | 2562 | GPC5 | 13 | 92,117,688 |
| 2563 | GPC5 | 13 | 92,117,738 | 2564 | GPC5 | 13 | 92,121,147 |
| 2565 | GPC5 | 13 | 92,121,270 | 2566 | GPC6 | 13 | 92,948,013 |
| 2567 | GPC6 | 13 | 93,081,095 | 2568 | GPC6 | 13 | 93,115,588 |
| 2569 | GPC6 | 13 | 93,183,430 | 2570 | GPC6 | 13 | 93,185,878 |
| 2571 | GPC6 | 13 | 93,196,895 | 2572 | GPC6 | 13 | 93,196,981 |
| 2573 | GPC6 | 13 | 93,197,927 | 2574 | GPC6 | 13 | 93,235,757 |
| 2575 | GPC6 | 13 | 93,235,896 | 2576 | GPC6 | 13 | 93,243,178 |
| 2577 | GPC6 | 13 | 93,243,273 | 2578 | GPC6 | 13 | 93,244,881 |
| 2579 | GPC6 | 13 | 93,249,369 | 2580 | GPC6 | 13 | 93,253,982 |
| 2581 | GPC6 | 13 | 93,254,425 | 2582 | GPC6 | 13 | 93,254,940 |
| 2583 | GPC6 | 13 | 93,259,422 | 2584 | GPC6 | 13 | 93,288,101 |
| 2585 | GPC6 | 13 | 93,289,027 | 2586 | GPC6 | 13 | 93,317,951 |
| 2587 | GPC6 | 13 | 93,340,807 | 2588 | GPC6 | 13 | 93,341,695 |
| 2589 | GPC6 | 13 | 93,863,160 | 2590 | NALCN | 13 | 100,499,428 |
| 2591 | NALCN | 13 | 100,499,748 | 2592 | NALCN | 13 | 100,502,077 |
| 2593 | NALCN | 13 | 100,507,599 | 2594 | NALCN | 13 | 100,510,427 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 2595 | NALCN | 13 | 100,511,470 | 2596 | NALCN | 13 | 100,518,301 |
| 2597 | NALCN | 13 | 100,524,314 | 2598 | NALCN | 13 | 100,524,587 |
| 2599 | NALCN | 13 | 100,530,564 | 2600 | NALCN | 13 | 100,535,000 |
| 2601 | NALCN | 13 | 100,595,841 | 2602 | NALCN | 13 | 100,742,753 |
| 2603 | ITGBL1 | 13 | 100,956,004 | 2604 | ITGBL1 | 13 | 100,973,881 |
| 2605 | ITGBL1 | 13 | 100,973,899 | 2606 | ITGBL1 | 13 | 101,140,742 |
| 2607 | ITGBL1 | 13 | 101,146,706 | 2608 | ITGBL1 | 13 | 101,163,997 |
| 2609 | ITGBL1 | 13 | 101,164,826 | 2610 | ITGBL1 | 13 | 101,165,404 |
| 2611 | ITGBL1 | 13 | 101,165,489 | 2612 | FGF14 | 13 | 101,224,288 |
| 2613 | FGF14 | 13 | 101,249,030 | 2614 | FGF14 | 13 | 101,881,550 |
| 2615 | TTC5 | 14 | 19,786,681 | 2616 | TTC5 | 14 | 19,826,727 |
| 2617 | TTC5 | 14 | 19,827,644 | 2618 | TTC5 | 14 | 19,833,934 |
| 2619 | TTC5 | 14 | 19,834,425 | 2620 | TTC5 | 14 | 19,837,458 |
| 2621 | TTC5 | 14 | 19,839,876 | 2622 | TTC5 | 14 | 19,845,685 |
| 2623 | TEP1 | 14 | 19,921,869 | 2624 | TEP1 | 14 | 19,922,610 |
| 2625 | TEP1 | 14 | 19,922,657 | 2626 | TEP1 | 14 | 19,945,109 |
| 2627 | WDR23 | 14 | 23,664,573 | 2628 | NOVA1 | 14 | 25,943,292 |
| 2629 | NOVA1 | 14 | 26,098,029 | 2630 | NOVA1 | 14 | 26,159,322 |
| 2631 | SLC25A21 | 14 | 36,224,345 | 2632 | SLC25A21 | 14 | 36,352,544 |
| 2633 | SLC25A21 | 14 | 36,558,361 | 2634 | SLC25A21 | 14 | 36,619,169 |
| 2635 | SLC25A21 | 14 | 36,727,597 | 2636 | GNG2 | 14 | 51,393,655 |
| 2637 | GNG2 | 14 | 51,394,658 | 2638 | GNG2 | 14 | 51,395,147 |
| 2639 | GNG2 | 14 | 51,406,432 | 2640 | GNG2 | 14 | 51,419,524 |
| 2641 | GNG2 | 14 | 51,422,662 | 2642 | GNG2 | 14 | 51,422,700 |
| 2643 | GNG2 | 14 | 51,428,644 | 2644 | GNG2 | 14 | 51,480,711 |
| 2645 | GNG2 | 14 | 51,480,818 | 2646 | GNG2 | 14 | 51,486,162 |
| 2647 | GNG2 | 14 | 51,520,930 | 2648 | SAMD4A | 14 | 54,092,204 |
| 2649 | SAMD4A | 14 | 54,169,379 | 2650 | SAMD4A | 14 | 54,327,340 |
| 2651 | DAAM1 | 14 | 58,765,383 | 2652 | DAAM1 | 14 | 58,768,753 |
| 2653 | DAAM1 | 14 | 58,874,752 | 2654 | DAAM1 | 14 | 58,883,684 |
| 2655 | DAAM1 | 14 | 58,899,726 | 2656 | GPR135 | 14 | 58,952,891 |
| 2657 | GPR135 | 14 | 58,954,960 | 2658 | GPR135 | 14 | 58,961,544 |
| 2659 | GPR135 | 14 | 58,963,400 | 2660 | GPR135 | 14 | 58,997,129 |
| 2661 | PPP2R5E | 14 | 62,856,367 | 2662 | PPP2R5E | 14 | 62,856,493 |
| 2663 | PPP2R5E | 14 | 63,040,607 | 2664 | PPP2R5E | 14 | 63,044,719 |
| 2665 | PPP2R5E | 14 | 63,050,455 | 2666 | PPP2R5E | 14 | 63,050,484 |
| 2667 | PPP2R5E | 14 | 63,060,864 | 2668 | PPP2R5E | 14 | 63,078,186 |
| 2669 | PPP2R5E | 14 | 63,099,534 | 2670 | PPP2R5E | 14 | 63,125,605 |
| 2671 | RGS6 | 14 | 71,433,141 | 2672 | RGS6 | 14 | 71,436,529 |
| 2673 | RGS6 | 14 | 71,727,478 | 2674 | RGS6 | 14 | 71,785,834 |
| 2675 | RGS6 | 14 | 71,789,406 | 2676 | RGS6 | 14 | 71,792,071 |
| 2677 | RGS6 | 14 | 71,793,717 | 2678 | RGS6 | 14 | 71,796,649 |
| 2679 | RGS6 | 14 | 71,801,725 | 2680 | RGS6 | 14 | 71,889,437 |
| 2681 | RGS6 | 14 | 71,979,491 | 2682 | RGS6 | 14 | 71,990,360 |
| 2683 | RGS6 | 14 | 72,012,929 | 2684 | RGS6 | 14 | 72,024,776 |
| 2685 | RGS6 | 14 | 72,124,860 | 2686 | KCNK10 | 14 | 87,843,799 |
| 2687 | KCNK10 | 14 | 87,844,293 | 2688 | KCNK10 | 14 | 87,869,850 |
| 2689 | KCNK10 | 14 | 87,874,319 | 2690 | KCNK10 | 14 | 87,874,519 |
| 2691 | KCNK10 | 14 | 87,877,121 | 2692 | KCNK10 | 14 | 87,878,632 |
| 2693 | KCNK10 | 14 | 87,881,781 | 2694 | KCNK10 | 14 | 87,887,777 |
| 2695 | KCNK13 | 14 | 89,678,960 | 2696 | KCNK13 | 14 | 89,686,350 |
| 2697 | KCNK13 | 14 | 89,697,368 | 2698 | RPS6KA5 | 14 | 90,544,201 |
| 2699 | RPS6KA5 | 14 | 90,576,018 | 2700 | CCDC88C | 14 | 90,843,321 |
| 2701 | CCDC88C | 14 | 90,862,073 | 2702 | CCDC88C | 14 | 90,914,886 |
| 2703 | CCDC88C | 14 | 90,916,433 | 2704 | CCDC88C | 14 | 90,918,598 |
| 2705 | CCDC88C | 14 | 90,919,949 | 2706 | CCDC88C | 14 | 90,920,049 |
| 2707 | CCDC88C | 14 | 90,926,910 | 2708 | CCDC88C | 14 | 90,944,709 |
| 2709 | CCDC88C | 14 | 90,960,430 | 2710 | ATXN3 | 14 | 91,626,364 |
| 2711 | ATP10A | 15 | 23,496,768 | 2712 | ATP10A | 15 | 23,504,291 |
| 2713 | ATP10A | 15 | 23,505,611 | 2714 | ATP10A | 15 | 23,507,697 |
| 2715 | ATP10A | 15 | 23,513,151 | 2716 | ATP10A | 15 | 23,653,372 |
| 2717 | ATP10A | 15 | 23,829,032 | 2718 | RYR3 | 15 | 31,507,942 |
| 2719 | RYR3 | 15 | 31,533,192 | 2720 | RYR3 | 15 | 31,534,443 |
| 2721 | RYR3 | 15 | 31,536,045 | 2722 | RYR3 | 15 | 31,542,264 |
| 2723 | RYR3 | 15 | 31,542,373 | 2724 | RYR3 | 15 | 31,545,132 |
| 2725 | RYR3 | 15 | 31,550,764 | 2726 | RYR3 | 15 | 31,551,413 |
| 2727 | RYR3 | 15 | 31,564,997 | 2728 | RYR3 | 15 | 31,566,783 |
| 2729 | RYR3 | 15 | 31,567,171 | 2730 | RYR3 | 15 | 31,623,922 |
| 2731 | RYR3 | 15 | 31,646,227 | 2732 | RYR3 | 15 | 31,744,674 |
| 2733 | RYR3 | 15 | 31,803,566 | 2734 | RYR3 | 15 | 31,921,882 |
| 2735 | C15ORF41 | 15 | 34,771,254 | 2736 | C15ORF41 | 15 | 34,847,872 |
| 2737 | C15ORF41 | 15 | 34,859,591 | 2738 | C15ORF41 | 15 | 34,862,071 |
| 2739 | C15ORF41 | 15 | 34,863,762 | 2740 | C15ORF41 | 15 | 34,863,820 |
| 2741 | C15ORF41 | 15 | 34,864,057 | 2742 | MEIS2 | 15 | 34,955,596 |
| 2743 | MEIS2 | 15 | 35,081,084 | 2744 | MEIS2 | 15 | 35,086,366 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 2745 | MEIS2 | 15 | 35,091,425 | 2746 | RASGRP1 | 15 | 36,656,958 |
| 2747 | KIAA1370 | 15 | 50,614,631 | 2748 | KIAA1370 | 15 | 50,617,081 |
| 2749 | UNC13C | 15 | 52,127,362 | 2750 | UNC13C | 15 | 52,127,720 |
| 2751 | UNC13C | 15 | 52,134,616 | 2752 | UNC13C | 15 | 52,176,418 |
| 2753 | UNC13C | 15 | 52,178,602 | 2754 | UNC13C | 15 | 52,179,635 |
| 2755 | UNC13C | 15 | 52,182,570 | 2756 | UNC13C | 15 | 52,222,738 |
| 2757 | UNC13C | 15 | 52,224,076 | 2758 | UNC13C | 15 | 52,243,049 |
| 2759 | UNC13C | 15 | 52,337,529 | 2760 | UNC13C | 15 | 52,337,770 |
| 2761 | UNC13C | 15 | 52,338,559 | 2762 | UNC13C | 15 | 52,357,520 |
| 2763 | UNC13C | 15 | 52,357,746 | 2764 | UNC13C | 15 | 52,465,606 |
| 2765 | UNC13C | 15 | 52,658,396 | 2766 | UNC13C | 15 | 52,682,121 |
| 2767 | UNC13C | 15 | 52,708,142 | 2768 | NEDD4 | 15 | 53,987,004 |
| 2769 | CGNL1 | 15 | 55,460,127 | 2770 | CGNL1 | 15 | 55,460,219 |
| 2771 | CGNL1 | 15 | 55,501,043 | 2772 | GRINL1A | 15 | 55,689,523 |
| 2773 | GRINL1A | 15 | 55,692,212 | 2774 | GRINL1A | 15 | 55,705,948 |
| 2775 | GRINL1A | 15 | 55,713,128 | 2776 | GRINL1A | 15 | 55,718,309 |
| 2777 | ADAM10 | 15 | 56,701,618 | 2778 | ADAM10 | 15 | 56,708,490 |
| 2779 | ADAM10 | 15 | 56,810,507 | 2780 | ADAM10 | 15 | 56,829,655 |
| 2781 | CLK3 | 15 | 72,702,941 | 2782 | TBC1D2B | 15 | 75,940,905 |
| 2783 | TBC1D2B | 15 | 76,083,890 | 2784 | TBC1D2B | 15 | 76,098,398 |
| 2785 | ARNT2 | 15 | 78,583,183 | 2786 | ARNT2 | 15 | 78,673,568 |
| 2787 | ARNT2 | 15 | 78,674,561 | 2788 | ARNT2 | 15 | 78,694,359 |
| 2789 | AKAP13 | 15 | 83,807,339 | 2790 | AKAP13 | 15 | 83,811,108 |
| 2791 | AKAP13 | 15 | 83,840,475 | 2792 | AKAP13 | 15 | 83,841,141 |
| 2793 | AKAP13 | 15 | 83,841,398 | 2794 | AKAP13 | 15 | 83,847,837 |
| 2795 | AKAP13 | 15 | 83,848,290 | 2796 | AKAP13 | 15 | 83,851,894 |
| 2797 | AKAP13 | 15 | 83,857,466 | 2798 | AKAP13 | 15 | 83,864,137 |
| 2799 | AKAP13 | 15 | 83,865,972 | 2800 | AKAP13 | 15 | 83,870,122 |
| 2801 | AKAP13 | 15 | 83,871,692 | 2802 | AKAP13 | 15 | 83,880,838 |
| 2803 | AKAP13 | 15 | 83,921,005 | 2804 | AKAP13 | 15 | 83,929,645 |
| 2805 | AKAP13 | 15 | 83,941,483 | 2806 | AKAP13 | 15 | 83,961,445 |
| 2807 | AKAP13 | 15 | 84,001,703 | 2808 | AKAP13 | 15 | 84,017,421 |
| 2809 | AKAP13 | 15 | 84,019,771 | 2810 | AKAP13 | 15 | 84,025,574 |
| 2811 | AKAP13 | 15 | 84,034,013 | 2812 | AKAP13 | 15 | 84,052,538 |
| 2813 | AKAP13 | 15 | 84,052,594 | 2814 | AKAP13 | 15 | 84,060,543 |
| 2815 | AKAP13 | 15 | 84,061,704 | 2816 | SV2B | 15 | 89,609,732 |
| 2817 | SLCO3A1 | 15 | 90,284,500 | 2818 | SLCO3A1 | 15 | 90,441,591 |
| 2819 | SLCO3A1 | 15 | 90,464,205 | 2820 | SLCO3A1 | 15 | 90,499,647 |
| 2821 | ST8SIA2 | 15 | 90,747,330 | 2822 | RGMA | 15 | 91,386,979 |
| 2823 | IGF1R | 15 | 97,045,310 | 2824 | IGF1R | 15 | 97,046,853 |
| 2825 | IGF1R | 15 | 97,049,391 | 2826 | A2BP1 | 16 | 6,249,617 |
| 2827 | A2BP1 | 16 | 6,251,202 | 2828 | A2BP1 | 16 | 6,253,029 |
| 2829 | A2BP1 | 16 | 6,657,066 | 2830 | A2BP1 | 16 | 6,688,743 |
| 2831 | A2BP1 | 16 | 7,419,133 | 2832 | A2BP1 | 16 | 7,628,696 |
| 2833 | A2BP1 | 16 | 7,629,108 | 2834 | A2BP1 | 16 | 7,630,524 |
| 2835 | A2BP1 | 16 | 7,632,187 | 2836 | A2BP1 | 16 | 7,706,480 |
| 2837 | TMC5 | 16 | 19,254,444 | 2838 | TMC5 | 16 | 19,378,267 |
| 2839 | N4BP1 | 16 | 47,114,074 | 2840 | N4BP1 | 16 | 47,129,091 |
| 2841 | GOT2 | 16 | 57,298,868 | 2842 | GOT2 | 16 | 57,300,955 |
| 2843 | GOT2 | 16 | 57,314,899 | 2844 | GOT2 | 16 | 57,317,440 |
| 2845 | GOT2 | 16 | 57,318,951 | 2846 | GOT2 | 16 | 57,319,081 |
| 2847 | GOT2 | 16 | 57,319,812 | 2848 | GOT2 | 16 | 57,360,362 |
| 2849 | GOT2 | 16 | 57,361,735 | 2850 | GOT2 | 16 | 57,361,866 |
| 2851 | GOT2 | 16 | 57,362,682 | 2852 | GOT2 | 16 | 57,394,412 |
| 2853 | GOT2 | 16 | 57,421,815 | 2854 | WWOX | 16 | 76,669,764 |
| 2855 | WWOX | 16 | 76,671,254 | 2856 | WWOX | 16 | 76,673,175 |
| 2857 | WWOX | 16 | 76,674,781 | 2858 | PLCG2 | 16 | 80,579,047 |
| 2859 | MPHOSPH6 | 16 | 80,702,549 | 2860 | MPHOSPH6 | 16 | 80,726,886 |
| 2861 | MPHOSPH6 | 16 | 80,728,226 | 2862 | MPHOSPH6 | 16 | 80,743,884 |
| 2863 | MPHOSPH6 | 16 | 80,757,604 | 2864 | MPHOSPH6 | 16 | 80,763,959 |
| 2865 | MPHOSPH6 | 16 | 80,765,783 | 2866 | MPHOSPH6 | 16 | 80,765,856 |
| 2867 | MPHOSPH6 | 16 | 80,820,057 | 2868 | CDH13 | 16 | 81,812,818 |
| 2869 | CDH13 | 16 | 81,896,946 | 2870 | CDH13 | 16 | 81,904,078 |
| 2871 | CDH13 | 16 | 81,905,756 | 2872 | CDH13 | 16 | 81,917,154 |
| 2873 | CDH13 | 16 | 82,328,997 | 2874 | CDH13 | 16 | 82,331,866 |
| 2875 | KIAA0182 | 16 | 84,248,252 | 2876 | KIAA0182 | 16 | 84,260,191 |
| 2877 | KIAA0182 | 16 | 84,263,548 | 2878 | KIAA0182 | 16 | 84,264,134 |
| 2879 | KIAA0182 | 16 | 84,269,361 | 2880 | GAS7 | 17 | 9,747,805 |
| 2881 | DNAH9 | 17 | 11,408,733 | 2882 | DNAH9 | 17 | 11,776,046 |
| 2883 | DNAH9 | 17 | 11,806,187 | 2884 | RAB11FIP4 | 17 | 26,867,375 |
| 2885 | RAB11FIP4 | 17 | 27,004,572 | 2886 | RAB11FIP4 | 17 | 27,005,299 |
| 2887 | CA10 | 17 | 47,587,715 | 2888 | CA10 | 17 | 47,983,984 |
| 2889 | CA10 | 17 | 48,008,209 | 2890 | CA10 | 17 | 48,026,031 |
| 2891 | CA10 | 17 | 48,122,155 | 2892 | CA10 | 17 | 48,154,827 |
| 2893 | MSI2 | 17 | 53,002,826 | 2894 | MSI2 | 17 | 53,007,065 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 2895 | SDK2 | 17 | 68,953,741 | 2896 | SDK2 | 17 | 68,954,425 |
| 2897 | DNAH17 | 17 | 73,954,236 | 2898 | DNAH17 | 17 | 74,016,132 |
| 2899 | DNAH17 | 17 | 74,017,503 | 2900 | HRNBP3 | 17 | 75,313,177 |
| 2901 | HRNBP3 | 17 | 75,313,214 | 2902 | DLGAP1 | 18 | 3,603,827 |
| 2903 | DLGAP1 | 18 | 3,605,943 | 2904 | ZFP161 | 18 | 5,237,432 |
| 2905 | ZFP161 | 18 | 5,240,346 | 2906 | ZFP161 | 18 | 5,251,246 |
| 2907 | ZFP161 | 18 | 5,280,198 | 2908 | ZFP161 | 18 | 5,283,875 |
| 2909 | ZFP161 | 18 | 5,283,943 | 2910 | ZFP161 | 18 | 5,284,323 |
| 2911 | PTPRM | 18 | 7,978,643 | 2912 | PTPRM | 18 | 8,000,444 |
| 2913 | PTPRM | 18 | 8,012,573 | 2914 | PTPRM | 18 | 8,013,359 |
| 2915 | PTPRM | 18 | 8,021,623 | 2916 | PTPRM | 18 | 8,024,067 |
| 2917 | PTPRM | 18 | 8,040,886 | 2918 | PTPRM | 18 | 8,042,261 |
| 2919 | PTPRM | 18 | 8,059,868 | 2920 | PTPRM | 18 | 8,068,553 |
| 2921 | PTPRM | 18 | 8,070,357 | 2922 | PTPRM | 18 | 8,075,047 |
| 2923 | PTPRM | 18 | 8,086,608 | 2924 | KIAA0802 | 18 | 8,832,312 |
| 2925 | KIAA0802 | 18 | 8,833,160 | 2926 | KIAA0802 | 18 | 8,839,087 |
| 2927 | KIAA0802 | 18 | 8,840,062 | 2928 | KIAA0802 | 18 | 8,844,132 |
| 2929 | OSBPL1A | 18 | 20,042,294 | 2930 | OSBPL1A | 18 | 20,076,380 |
| 2931 | OSBPL1A | 18 | 20,093,929 | 2932 | CHST9 | 18 | 22,940,363 |
| 2933 | CHST9 | 18 | 22,960,659 | 2934 | CHST9 | 18 | 22,965,754 |
| 2935 | CHST9 | 18 | 23,000,286 | 2936 | CHST9 | 18 | 23,010,213 |
| 2937 | CHST9 | 18 | 23,012,354 | 2938 | CHST9 | 18 | 23,015,926 |
| 2939 | FUSSEL18 | 18 | 43,092,404 | 2940 | FUSSEL18 | 18 | 43,096,405 |
| 2941 | FUSSEL18 | 18 | 43,105,881 | 2942 | KIAA0427 | 18 | 44,356,926 |
| 2943 | KIAA0427 | 18 | 44,410,788 | 2944 | KIAA0427 | 18 | 44,488,963 |
| 2945 | KIAA0427 | 18 | 44,489,439 | 2946 | KIAA0427 | 18 | 44,494,468 |
| 2947 | KIAA0427 | 18 | 44,494,709 | 2948 | KIAA0427 | 18 | 44,495,161 |
| 2949 | KIAA0427 | 18 | 44,594,841 | 2950 | KIAA0427 | 18 | 44,622,539 |
| 2951 | DCC | 18 | 48,523,497 | 2952 | DCC | 18 | 48,581,071 |
| 2953 | DCC | 18 | 48,606,324 | 2954 | DCC | 18 | 48,607,209 |
| 2955 | DCC | 18 | 48,608,936 | 2956 | DCC | 18 | 48,609,120 |
| 2957 | DCC | 18 | 48,609,275 | 2958 | DCC | 18 | 48,609,314 |
| 2959 | DCC | 18 | 48,709,007 | 2960 | DCC | 18 | 48,872,357 |
| 2961 | DCC | 18 | 48,876,855 | 2962 | DCC | 18 | 48,877,638 |
| 2963 | DCC | 18 | 49,023,541 | 2964 | DCC | 18 | 49,067,285 |
| 2965 | DCC | 18 | 49,159,204 | 2966 | DCC | 18 | 49,159,355 |
| 2967 | DCC | 18 | 49,159,861 | 2968 | DCC | 18 | 49,160,029 |
| 2969 | DCC | 18 | 49,311,296 | 2970 | NEDD4L | 18 | 53,901,050 |
| 2971 | NEDD4L | 18 | 53,910,209 | 2972 | NEDD4L | 18 | 53,913,025 |
| 2973 | NEDD4L | 18 | 54,257,576 | 2974 | CCBE1 | 18 | 55,266,769 |
| 2975 | TXNDC10 | 18 | 64,472,145 | 2976 | TXNDC10 | 18 | 64,477,750 |
| 2977 | TXNDC10 | 18 | 64,478,795 | 2978 | TXNDC10 | 18 | 64,483,488 |
| 2979 | TXNDC10 | 18 | 64,509,383 | 2980 | TXNDC10 | 18 | 64,531,445 |
| 2981 | TXNDC10 | 18 | 64,536,945 | 2982 | TXNDC10 | 18 | 64,644,387 |
| 2983 | DOK6 | 18 | 65,007,777 | 2984 | DOK6 | 18 | 65,239,042 |
| 2985 | DOK6 | 18 | 65,284,947 | 2986 | DOK6 | 18 | 65,290,269 |
| 2987 | DOK6 | 18 | 65,297,738 | 2988 | DOK6 | 18 | 65,312,795 |
| 2989 | DOK6 | 18 | 65,312,915 | 2990 | DOK6 | 18 | 65,323,078 |
| 2991 | DOK6 | 18 | 65,324,331 | 2992 | DOK6 | 18 | 65,413,042 |
| 2993 | DOK6 | 18 | 65,421,361 | 2994 | DOK6 | 18 | 65,437,247 |
| 2995 | DOK6 | 18 | 65,637,817 | 2996 | MBP | 18 | 72,849,372 |
| 2997 | MBP | 18 | 72,851,555 | 2998 | MBP | 18 | 72,856,606 |
| 2999 | MBP | 18 | 73,014,458 | 3000 | MBP | 18 | 73,015,500 |
| 3001 | LDLR | 19 | 11,097,804 | 3002 | ZNF667 | 19 | 61,676,582 |
| 3003 | ZNF667 | 19 | 61,678,984 | 3004 | ATRN | 20 | 3,553,336 |
| 3005 | RNF24 | 20 | 3,865,215 | 3006 | RNF24 | 20 | 3,865,397 |
| 3007 | RNF24 | 20 | 3,882,766 | 3008 | RNF24 | 20 | 3,941,491 |
| 3009 | PRNT | 20 | 4,653,718 | 3010 | PRNT | 20 | 4,653,865 |
| 3011 | PRNT | 20 | 4,667,449 | 3012 | PRNT | 20 | 4,679,109 |
| 3013 | PRNT | 20 | 4,679,377 | 3014 | FERMT1 | 20 | 5,998,478 |
| 3015 | FERMT1 | 20 | 6,010,641 | 3016 | FERMT1 | 20 | 6,025,907 |
| 3017 | FERMT1 | 20 | 6,033,216 | 3018 | FERMT1 | 20 | 6,037,513 |
| 3019 | FERMT1 | 20 | 6,037,952 | 3020 | PLCB1 | 20 | 8,062,704 |
| 3021 | PLCB1 | 20 | 8,082,140 | 3022 | PLCB1 | 20 | 8,092,135 |
| 3023 | PLCB1 | 20 | 8,109,126 | 3024 | PLCB1 | 20 | 8,198,182 |
| 3025 | PLCB1 | 20 | 8,198,311 | 3026 | PLCB1 | 20 | 8,318,230 |
| 3027 | PLCB1 | 20 | 8,340,262 | 3028 | PLCB4 | 20 | 9,114,332 |
| 3029 | PLCB4 | 20 | 9,119,736 | 3030 | PLCB4 | 20 | 9,129,662 |
| 3031 | PLCB4 | 20 | 9,137,987 | 3032 | PLCB4 | 20 | 9,142,973 |
| 3033 | PLCB4 | 20 | 9,411,693 | 3034 | PLCB4 | 20 | 9,418,063 |
| 3035 | PLCB4 | 20 | 9,419,575 | 3036 | JAG1 | 20 | 10,587,841 |
| 3037 | JAG1 | 20 | 10,589,470 | 3038 | JAG1 | 20 | 10,589,575 |

TABLE A-continued

Summary of SNPs (NCBI Human Genome Reference Assembly Build 36.3)

| SEQ ID NO: | Gene | Chr | Position (BP) | SEQ ID NO: | Gene | Chr | Position (BP) |
|---|---|---|---|---|---|---|---|
| 3039 | MACROD2 | 20 | 14,254,953 | 3040 | MACROD2 | 20 | 15,085,117 |
| 3041 | MACROD2 | 20 | 15,413,513 | 3042 | MACROD2 | 20 | 15,414,269 |
| 3043 | MACROD2 | 20 | 15,424,726 | 3044 | MACROD2 | 20 | 15,438,760 |
| 3045 | MACROD2 | 20 | 15,443,389 | 3046 | MACROD2 | 20 | 15,756,444 |
| 3047 | MACROD2 | 20 | 15,775,930 | 3048 | MACROD2 | 20 | 15,780,282 |
| 3049 | MACROD2 | 20 | 15,951,406 | 3050 | KIF16B | 20 | 16,200,981 |
| 3051 | KIF16B | 20 | 16,418,749 | 3052 | PTPRT | 20 | 40,087,340 |
| 3053 | PTPRT | 20 | 40,173,455 | 3054 | PTPRT | 20 | 40,508,810 |
| 3055 | PTPRT | 20 | 40,510,165 | 3056 | PTPRT | 20 | 40,515,646 |
| 3057 | PTPRT | 20 | 40,714,518 | 3058 | PTPRT | 20 | 40,781,649 |
| 3059 | KCNB1 | 20 | 47,550,362 | 3060 | PTGIS | 20 | 47,554,184 |
| 3061 | PTGIS | 20 | 47,563,113 | 3062 | PTGIS | 20 | 47,563,394 |
| 3063 | PTGIS | 20 | 47,563,735 | 3064 | PTGIS | 20 | 47,600,610 |
| 3065 | BMP7 | 20 | 55,192,062 | 3066 | BMP7 | 20 | 55,237,584 |
| 3067 | BMP7 | 20 | 55,238,534 | 3068 | BMP7 | 20 | 55,243,363 |
| 3069 | BMP7 | 20 | 55,257,169 | 3070 | BMP7 | 20 | 55,258,167 |
| 3071 | GNAS | 20 | 56,912,202 | 3072 | GNAS | 20 | 56,919,207 |
| 3073 | CDH4 | 20 | 59,236,556 | 3074 | CDH4 | 20 | 59,263,242 |
| 3075 | CDH4 | 20 | 59,287,333 | 3076 | CDH4 | 20 | 59,349,681 |
| 3077 | CDH4 | 20 | 59,408,443 | 3078 | CDH4 | 20 | 59,409,551 |
| 3079 | CDH4 | 20 | 59,410,397 | 3080 | CDH4 | 20 | 59,411,482 |
| 3081 | CDH4 | 20 | 59,439,102 | 3082 | CDH4 | 20 | 59,513,826 |
| 3083 | CDH4 | 20 | 59,708,684 | 3084 | CDH4 | 20 | 59,709,160 |
| 3085 | CDH4 | 20 | 59,710,358 | 3086 | CDH4 | 20 | 59,832,199 |
| 3087 | CDH4 | 20 | 59,852,651 | 3088 | CDH4 | 20 | 59,854,564 |
| 3089 | CDH4 | 20 | 59,855,625 | 3090 | NCAM2 | 21 | 20,820,603 |
| 3091 | NCAM2 | 21 | 20,822,764 | 3092 | NCAM2 | 21 | 20,823,179 |
| 3093 | NCAM2 | 21 | 21,401,668 | 3094 | NCAM2 | 21 | 21,485,064 |
| 3095 | NCAM2 | 21 | 21,654,800 | 3096 | NCAM2 | 21 | 21,654,816 |
| 3097 | NCAM2 | 21 | 21,658,511 | 3098 | NCAM2 | 21 | 21,664,277 |
| 3099 | NCAM2 | 21 | 21,667,058 | 3100 | NCAM2 | 21 | 21,670,625 |
| 3101 | NCAM2 | 21 | 21,677,311 | 3102 | NCAM2 | 21 | 21,686,082 |
| 3103 | NCAM2 | 21 | 21,692,759 | 3104 | NCAM2 | 21 | 21,706,609 |
| 3105 | NCAM2 | 21 | 21,717,043 | 3106 | NCAM2 | 21 | 21,722,038 |
| 3107 | NCAM2 | 21 | 21,770,148 | 3108 | NCAM2 | 21 | 21,772,362 |
| 3109 | ERG | 21 | 38,829,307 | 3110 | PCP4 | 21 | 40,190,608 |
| 3111 | PCP4 | 21 | 40,196,614 | 3112 | PCP4 | 21 | 40,198,160 |
| 3113 | SLC37A1 | 21 | 42,826,920 | 3114 | SLC37A1 | 21 | 42,829,968 |
| 3115 | SLC37A1 | 21 | 42,833,146 | 3116 | SLC37A1 | 21 | 42,895,327 |
| 3117 | PDE9A | 21 | 42,977,018 | 3118 | PDE9A | 21 | 42,990,494 |
| 3119 | PDE9A | 21 | 43,064,200 | 3120 | ARVCF | 22 | 18,342,203 |
| 3121 | ASPHD2 | 22 | 25,171,390 | 3122 | ASPHD2 | 22 | 25,171,643 |
| 3123 | HPS4 | 22 | 25,174,769 | 3124 | TTLL1 | 22 | 41,800,470 |
| 3125 | EFCAB6 | 22 | 42,373,315 | 3126 | EFCAB6 | 22 | 42,397,103 |
| 3127 | EFCAB6 | 22 | 42,417,370 | 3128 | EFCAB6 | 22 | 42,454,850 |
| 3129 | EFCAB6 | 22 | 42,521,911 | 3130 | SULT4A1 | 22 | 42,542,231 |
| 3131 | SULT4A1 | 22 | 42,551,476 | 3132 | SULT4A1 | 22 | 42,570,832 |
| 3133 | SULT4A1 | 22 | 42,580,796 | 3134 | SULT4A1 | 22 | 42,581,963 |
| 3135 | SULT4A1 | 22 | 42,582,522 | 3136 | SULT4A1 | 22 | 42,603,569 |
| 3137 | SULT4A1 | 22 | 42,603,783 | 3138 | RIBC2 | 22 | 44,257,648 |
| 3139 | RIBC2 | 22 | 44,258,667 | 3140 | RIBC2 | 22 | 44,265,997 |
| 3141 | RIBC2 | 22 | 44,271,097 | | | | |

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (3141 sequences)

SEQ ID NO: 1 - DNA, 61 bp, Homo Sapiens
gcgcccagcctgatgagtgactttaattgckctatgcttcagtcatctcagctaacacagg

SEQ ID NO: 2 - DNA, 61 bp, Homo Sapiens
ctgcctgttgccttgcttgagagtggattayagatggccaggggaatgaattccacaggag

SEQ ID NO: 3 - DNA, 61 bp, Homo Sapiens
gccagcggcttcaccggaagagcctctgcasggaagacggtttcaacaccacctaacggaa

SEQ ID NO: 4 - DNA, 61 bp, Homo Sapiens
gcttcttctagaaaagacaataaagctttgsaaccttctttccacttaccattcactagaa

SEQ ID NO: 5 - DNA, 61 bp, Homo Sapiens
gcatagtgaaagccgctcaccactggcttargaaactcccgggaggcagttgcaaagcttt

SEQ ID NO: 6 - DNA, 61 bp, Homo Sapiens
atgcagggtgggcataggagaatttacaagscctttacctctaagcctctgcagtttgttt

SEQ ID NO: 7 - DNA, 61 bp, Homo Sapiens
cacaagataggaaaaaatagaattagaaagwccaacttatatctaactggaatcccagaag

SEQ ID NO: 8 - DNA, 61 bp, Homo Sapiens
cctcacaccatcctgtgagattaagcgttcytatcatccccgttttacagaggggaaaacc

SEQ ID NO: 9 - DNA, 61 bp, Homo Sapiens
ctgtatccccttccctgccctatgccttgawgagttaagcgtaagagcccttgttcagcct

SEQ ID NO: 10 - DNA, 61 bp, Homo Sapiens
tagagaccatgtagttccagagtgggaaacrtagcacacaggttacgatctcccattccct

SEQ ID NO: 11 - DNA, 61 bp, Homo Sapiens
agtcattatcctcataaaaagacctgttcargtgtggtcacgtcttagtcttcttttctat

SEQ ID NO: 12 - DNA, 61 bp, Homo Sapiens
taaaatgcttgaggaaggtcttgagaaaacsctcactccctctaaacttttagcttctaca

SEQ ID NO: 13 - DNA, 61 bp, Homo Sapiens
agttgagggagtgataaagaatgttgacttyttccagatgaacaaagttgaatgaaaactt

SEQ ID NO: 14 - DNA, 61 bp, Homo Sapiens
aagtgctgctggtcagtttccagttcttccrctcttcaacttctgcaaaccgatttttcag

SEQ ID NO: 15 - DNA, 61 bp, Homo Sapiens
catcaacccaactcattcatatgcactcctsctcatgaagtctgattgagtctgcttgtgg

SEQ ID NO: 16 - DNA, 61 bp, Homo Sapiens
tagaacctgttggtaatcacctcttactgcyggggaagagtggaggattatctgagccaaa

SEQ ID NO: 17 - DNA, 61 bp, Homo Sapiens
gcaagatagatattagtactcctgctttttytgtcaactaaactgaggcacagagatgtta

SEQ ID NO: 18 - DNA, 61 bp, Homo Sapiens
gataagcccctttaacccaccgatcactgayatatgtgtgcaccacctagtggcacaagca

SEQ ID NO: 19 - DNA, 61 bp, Homo Sapiens
aacttggacttttcctgaatatcgaatctgycagtagcagagaccaatactgattctctga

SEQ ID NO: 20 - DNA, 61 bp, Homo Sapiens
tgagataggtttgtcattatcctcatttctscaatttatcctcattatgtagaggaaaaaa

SEQ ID NO: 21 - DNA, 61 bp, Homo Sapiens
atttgggaggatgttcacttctagctgagamagaataacagtttggatttaccctcccacc

SEQ ID NO: 22 - DNA, 61 bp, Homo Sapiens
tattggcattttaaaaaatgcaatttcatcrattatccctttctgccttcaaaagagttca

SEQ ID NO: 23 - DNA, 61 bp, Homo Sapiens
cttgcattcgaatgttcccattttataggcragaataccaacaaacagaagttaagaactt

SEQ ID NO: 24 - DNA, 61 bp, Homo Sapiens
ctgtgcccctttctgtagccttgctcactgraagttgaaataattagcatggaggttctgt

SEQ ID NO: 25 - DNA, 61 bp, Homo Sapiens
ttgaaccctgcattttccactataactagcrtctaataaaaaccaaccaagaatatttagt

SEQ ID NO: 26 - DNA, 61 bp, Homo Sapiens
ttccaatatattacactgcccctttaatgamaaacagctaccactggtgtagacatagaag

SEQ ID NO: 27 - DNA, 61 bp, Homo Sapiens
gatatgagaagatgctccacagcatatgtcwtctggaaattaaaactgaaacaacaatgaa

SEQ ID NO: 28 - DNA, 61 bp, Homo Sapiens
gaattgttgacaaagattgggataatttatrtagaatactggtacacattagggactcagt

SEQ ID NO: 29 - DNA, 61 bp, Homo Sapiens
tagctgagggtgaggcatatcctatcttgastttctgagcactctggtaccatggaatgtc

SEQ ID NO: 30 - DNA, 61 bp, Homo Sapiens
ttctccagggtacacatctaactttccccarctagtcctgatgtaatcttgtttgcctctt

SEQ ID NO: 31 - DNA, 61 bp, Homo Sapiens
tcacttggacagataattttgttgcctaagktattgcctctgagatatacttaggaactta

SEQ ID NO: 32 - DNA, 61 bp, Homo Sapiens
ttgattcaataaagatgagtcattaaaacaytgctgtggaattagttgtaagatcagcaat

SEQ ID NO: 33 - DNA, 61 bp, Homo Sapiens
tctctttcaacctccctgcatgacagctggmaagagcccatccctaatcttcaccaaccgg

SEQ ID NO: 34 - DNA, 61 bp, Homo Sapiens
ccagggaccagggggccatgaaagatgttawgtagagaagggtcagatttaggatttgaaa

SEQ ID NO: 35 - DNA, 61 bp, Homo Sapiens
tcatgaaactctgtatcctggagtggctcayggcatttaaaggcatttaaattcccagaga

SEQ ID NO: 36 - DNA, 61 bp, Homo Sapiens
catggaagccatgaccatactgaacatactytttgacttctcctgtcctatatcccgccat

SEQ ID NO: 37 - DNA, 61 bp, Homo Sapiens
aagggagtggttactatgcagggtatgaggktcctgaggagagattcctagtggaggctgg

SEQ ID NO: 38 - DNA, 61 bp, Homo Sapiens
gcacatgagacaggaacaaggccaagtgaaygcctggtgaccagatgctctgtggcctgta

SEQ ID NO: 39 - DNA, 61 bp, Homo Sapiens
ttttgtaactattacagaagttaaaatgtgwacagtagtgatccaaccacttcatgttaca

SEQ ID NO: 40 - DNA, 61 bp, Homo Sapiens
ttgcttgatataaagtggtagattatggtcrgatttttaaccaccaaaatgttcagagaat

SEQ ID NO: 41 - DNA, 61 bp, Homo Sapiens
ctccagcctggaccccagaagccgcttcctygaaggtctgctgaatccacttatttctttt

SEQ ID NO: 42 - DNA, 61 bp, Homo Sapiens
aagcagagaggaatggaagagtggaataacratgatggtaatagtttaagaagcattttgg

SEQ ID NO: 43 - DNA, 61 bp, Homo Sapiens
tattagatctctgtatttttttggtaacagkatgaaaaatctgttcagatgcacttcggac

SEQ ID NO: 44 - DNA, 61 bp, Homo Sapiens
gtctcacaaaatcaaagtgaagagttctacmatgggcctaacaggaacagactgttattaa

SEQ ID NO: 45 - DNA, 61 bp, Homo Sapiens
atataggattccatcaaaactgggccggttmcgatcaaagaaatactcatttctcatggag

SEQ ID NO: 46 - DNA, 61 bp, Homo Sapiens
gagacctggactttagaccctctacccccarttagctgtgagaccttgagcaaatcatttc

SEQ ID NO: 47 - DNA, 61 bp, Homo Sapiens
tatatactctgtgatctccagccacctctcytctttgttgttacttctctactctatgtag

SEQ ID NO: 48 - DNA, 61 bp, Homo Sapiens
agattaaaatccacagctgtctctacaagarggctactgtgggtgcatatatgcttgagag

SEQ ID NO: 49 - DNA, 61 bp, Homo Sapiens
gtcatctgttctgaaaggctacacacagtckccatctaacaataaatggtaaaagaaaaga

SEQ ID NO: 50 - DNA, 61 bp, Homo Sapiens
gactgagcaagtgagacatgcaagtcactcyattactaatgagggttgtaatccatctgta

SEQ ID NO: 51 - DNA, 61 bp, Homo Sapiens
tttacccaaaatataggagaagaatatcaarggatcatcctaacattttaatctgattcct

SEQ ID NO: 52 - DNA, 61 bp, Homo Sapiens
ttttccctaacttcagtcatctgagtacccyttgctagttttcacatgcccattttctgtc

SEQ ID NO: 53 - DNA, 61 bp, Homo Sapiens
ggcatgactgtatatccaaagctgtaaatayaaggtggattgtgatgaatgctatattagc

SEQ ID NO: 54 - DNA, 61 bp, Homo Sapiens
ggcagcactgatggtcagcttccccagcaargacaaggaatggctgttcaccactgcaaac

SEQ ID NO: 55 - DNA, 61 bp, Homo Sapiens
acattattattcttcctcttactcgattctratattgttgtggagagagactgggagactt

SEQ ID NO: 56 - DNA, 61 bp, Homo Sapiens
tgatgaattcatcttattagtcatcatgtcraaatgaaaatatagccctttcatcatgtta

SEQ ID NO: 57 - DNA, 61 bp, Homo Sapiens
ccatcccattactgggtcaaaggattataartaaatctgctataaagacacatgcacatgt

SEQ ID NO: 58 - DNA, 61 bp, Homo Sapiens
gaaaggaaaaggtacagtgtgtaagcacccrtcacatttaccaccatcgagtgtctgctgt

SEQ ID NO: 59 - DNA, 61 bp, Homo Sapiens
tgactagggaggcagagctacagagatttcrtgaatggacatcactgaggtagcgtaccaa

SEQ ID NO: 60 - DNA, 61 bp, Homo Sapiens
ttggaagtcctgtactcaaagattggacatrtatataaagtgagtatatgcagtgaccatt

SEQ ID NO: 61 - DNA, 61 bp, Homo Sapiens
ttctggaagaggtcttggaggggaaacagcragtagaggagcagctgaggctgcgggagcg

SEQ ID NO: 62 - DNA, 51 bp, Homo Sapiens
acttgaggaaaaggctcagttggcttgaaaygtccactcctacagtggaaa

SEQ ID NO: 63 - DNA, 61 bp, Homo Sapiens
accatagggcctctgttggtgggataggtgyctccattgtccttcactgctattctccttt

SEQ ID NO: 64 - DNA, 61 bp, Homo Sapiens
gtccaaagattctgctctctttgctgaactyggttatttcacagacactgatgagctgcaa

SEQ ID NO: 65 - DNA, 61 bp, Homo Sapiens
ttctaagaattaacctctgaaatttattagygctaaaaggatttgtcttattataaataac

SEQ ID NO: 66 - DNA, 61 bp, Homo Sapiens
ggctagaacttaggtcagttgactccaagtycagtgatacttacacaacagcttcaaactg

SEQ ID NO: 67 - DNA, 61 bp, Homo Sapiens
gagcaatcttagggtacctctctgatgtagmttttgtgggatttgttaactggtataatgt

SEQ ID NO: 68 - DNA, 61 bp, Homo Sapiens
aattcacaggcatattcttgagggaacataraagtaaccagtaacgctgctagtggcaatc

SEQ ID NO: 69 - DNA, 61 bp, Homo Sapiens
tgaagatctccctgctcttttcatcttaacrtaatttcagctttttgtgtgtggctctcca

SEQ ID NO: 70 - DNA, 61 bp, Homo Sapiens
acatgctaagagatttggaacactttagccrtagcgtctcatgatcactgccttttcacaa

SEQ ID NO: 71 - DNA, 61 bp, Homo Sapiens
actattaggagtatgtctaacattctgtttsgatttttcattttcaaattactgatttatc

SEQ ID NO: 72 - DNA, 61 bp, Homo Sapiens
tctaaaataacttgctttatgtttgagaaamgattgttcagtagtctgtaagtagacttgt

SEQ ID NO: 73 - DNA, 61 bp, Homo Sapiens
cacatatacatactctatgcattggcttagwtaatataaaaacagcacaggaatagtttat

SEQ ID NO: 74 - DNA, 61 bp, Homo Sapiens
ctatcagcagcattttgaataatcagagaarattcaacacaggagatgagaaccaggaaac

SEQ ID NO: 75 - DNA, 61 bp, Homo Sapiens
taaagggtcagtatgatgtttaggaaagcarcccacatttggagtcaaagccttttgttct

SEQ ID NO: 76 - DNA, 61 bp, Homo Sapiens
ctcaaccttctcctgtagtcttctcatcctrgtcacagtgaagcatatccgtccttcacat

SEQ ID NO: 77 - DNA, 61 bp, Homo Sapiens
ctcatttcattggccagaactgagtcacatsatgataacttgctgaagagaatttaggaaa

SEQ ID NO: 78 - DNA, 61 bp, Homo Sapiens
gtcttgattccttgccttctctttcatccayttttgatccatctgccaatcctattaactt

SEQ ID NO: 79 - DNA, 61 bp, Homo Sapiens
ctgaaaatcacccaggatagccaaatctaargggagtgctgcgctgcttaaaaaggtttgt

SEQ ID NO: 80 - DNA, 61 bp, Homo Sapiens
agaggagccccatggcagaagtgatacgacrcccctggacagcatgcatccgttgccagcc

SEQ ID NO: 81 - DNA, 61 bp, Homo Sapiens
taatactagatgactctttatcctcatcaaraggcttagacttcagtcctttaccacctgc

SEQ ID NO: 82 - DNA, 61 bp, Homo Sapiens
aaattagaattcatttttggctgtgcaaacraaacatttggccgtagtgtagctctaggac

SEQ ID NO: 83 - DNA, 61 bp, Homo Sapiens
ttgaagctagacaatgcctagacagccaaasctttcttctctgggccaccccctcctctca

SEQ ID NO: 84 - DNA, 61 bp, Homo Sapiens
aacttaccacagaaaaattcatttattcatyactggatacctcaatagccatcacaaagcc

SEQ ID NO: 85 - DNA, 61 bp, Homo Sapiens
attctaggcatcagccaattcatcgcttagkcatagaaaatcataacatgagaaaatcatg

SEQ ID NO: 86 - DNA, 61 bp, Homo Sapiens
taaaagtagacaaatcatagataatgagtcwtagggaacatctcagtcaacctttcaacaa

SEQ ID NO: 87 - DNA, 61 bp, Homo Sapiens
ttgagtgtgaggctcaataggagtaacatayatggaagcatttttgtaaacattaaagttc

SEQ ID NO: 88 - DNA, 61 bp, Homo Sapiens
agttcatccacagcaagtctgcagcagagarggagtatgaaagaagcttaagcacatggtt

SEQ ID NO: 89 - DNA, 61 bp, Homo Sapiens
gaggcaggcctcgcacagtgaccctgttgaygtgccatcctttattttgttttaataacaa

SEQ ID NO: 90 - DNA, 61 bp, Homo Sapiens
ctttgattagaaagattttctttttagcagrtcctatgtgctattgtcaagcctatattcg

SEQ ID NO: 91 - DNA, 61 bp, Homo Sapiens
ttccatacctctttcttcctgcagccactgwgggtgtccatgatagtaataacttccataa

SEQ ID NO: 92 - DNA, 61 bp, Homo Sapiens
gataccatactctttttaaaaatgctaatgygatttaaaatgtgatgttacattctatacg

SEQ ID NO: 93 - DNA, 61 bp, Homo Sapiens
ggaggtggcagggaggatctcttggataacygacacattttaaagtcattcattgctgttc

SEQ ID NO: 94 - DNA, 61 bp, Homo Sapiens
tttccttccctccactttgccagatctacgrctcctctcttctgcctggattccagaatct

SEQ ID NO: 95 - DNA, 61 bp, Homo Sapiens
aaaattcacgtgtgtacttgagatgatgacyttcaagcttctaacttatgtgaagagcagc

SEQ ID NO: 96 - DNA, 61 bp, Homo Sapiens
tggcttttacagtaagaggtcaggaagatgytttgtgcacaccaaatggaccaggcttttc

SEQ ID NO: 97 - DNA, 61 bp, Homo Sapiens
gcaggccctaatttatttgtgggataaaaasgatattgaatatgagagtggtgggaacatc

SEQ ID NO: 98 - DNA, 61 bp, Homo Sapiens
gaaaagtcagtaatataacagctacttggarcacctactataccttgcacattctatcatt

SEQ ID NO: 99 - DNA, 61 bp, Homo Sapiens
tgtcactgtacaatctcttatgggaatctaktcaggactctcagagtcaaccagatctatc

SEQ ID NO: 100 - DNA, 61 bp, Homo Sapiens
gcccagacaaggacactaaggatgatcaatrcccatggacttttgaggtgcctactactat

SEQ ID NO: 101 - DNA, 61 bp, Homo Sapiens
tgaaggtgagaggagagaggcacaagagccractgagccccagcgatggttccctcccagg

SEQ ID NO: 102 - DNA, 61 bp, Homo Sapiens
gaactgtcatctatccagttaaggacacaayaatgcagtcatctgaacatcaagtatctga

SEQ ID NO: 103 - DNA, 61 bp, Homo Sapiens
gtgtacttattatccgcactttatcattaarttcctgaaaagctagaacaaaacaaatccg

SEQ ID NO: 104 - DNA, 61 bp, Homo Sapiens
atactgatattctgttatattgagaagaaascaggggtaaataaggtcttttgacatttta

SEQ ID NO: 105 - DNA, 61 bp, Homo Sapiens
ttaaatttcttactctgatgcacgtagtttrtaagtggtaaatgaaatccaaacctaacta

SEQ ID NO: 106 - DNA, 61 bp, Homo Sapiens
tattattgtagaattgactcttaaactatgrccaagtacaggcaccagccaggcagatgtg

SEQ ID NO: 107 - DNA, 61 bp, Homo Sapiens
gctaatgtccagaaacagtaagaatcacacyggaacgagttgccagccagctgcccatata

SEQ ID NO: 108 - DNA, 61 bp, Homo Sapiens
gcacctctgcacttgcttgttacgtctccaraggtgattttgttgtgcagtccctaggaaa

SEQ ID NO: 109 - DNA, 61 bp, Homo Sapiens
gcagtccctaggaaagacttaaaatggaaaygctgtctttgagtggttatatgtaatacac

SEQ ID NO: 110 - DNA, 61 bp, Homo Sapiens
ggcaggcaatgaccagcatctctgatccaartgtggtgccccatgagctctaagctggtat

SEQ ID NO: 111 - DNA, 61 bp, Homo Sapiens
ggttttccaaaaccttgtcaaatccacacayttagtgaattcttattgacaatttaagtgc

SEQ ID NO: 112 - DNA, 61 bp, Homo Sapiens
ccttatcctacggagaagtcctgaccttctyggatcttacacatgaacagggtaggcaatg

SEQ ID NO: 113 - DNA, 61 bp, Homo Sapiens
ggcttggtggattgagggataagctagggcrtcttgagggaagagaaatagctaatgaagg

SEQ ID NO: 114 - DNA, 61 bp, Homo Sapiens
agttttctcccttctctgattgttttatccrtttttcattgaataggccatgctcttgtga

SEQ ID NO: 115 - DNA, 61 bp, Homo Sapiens
gatccctctggcagcatagatgaatgtaatrttgaaacaggaagatgtgtttgcaaagaca

SEQ ID NO: 116 - DNA, 61 bp, Homo Sapiens
ttttgaaaggaccattttggctttcatgttragattggagccattgtaggggagcaggtga

SEQ ID NO: 117 - DNA, 61 bp, Homo Sapiens
aaacctcggattcccagaaatttgagtctawttcaggccctactggttacaaagatatcac

SEQ ID NO: 118 - DNA, 61 bp, Homo Sapiens
gaggccctatgtatctctactcttctaaacrtcgcaactttctgccaggtttccacaaagc

SEQ ID NO: 119 - DNA, 61 bp, Homo Sapiens
aattttgttacaaatagtaccttgcatacamattatcacaaaacgtgaaaaattaaactag

SEQ ID NO: 120 - DNA, 61 bp, Homo Sapiens
ccttattgagcatccacaagcttgtctgcgmgtgtaaaaggagggagaaaggaccctgcca

SEQ ID NO: 121 - DNA, 61 bp, Homo Sapiens
gattagaagttcctttctttgttagaggggrgcatccattagacaaggcaattaattaaga

SEQ ID NO: 122 - DNA, 61 bp, Homo Sapiens
caaattttgacagtaagtcatggaggttttyattctagcctttgcttttggtaagcagagt

SEQ ID NO: 123 - DNA, 61 bp, Homo Sapiens
tctcattctttctttggcctagccaaatttyacatttcgaacccatctgccaagttttttg

SEQ ID NO: 124 - DNA, 61 bp, Homo Sapiens
aaataaatgctgctggcagtatgtgaccttrttttatctgctacagtttacagatgttaga

SEQ ID NO: 125 - DNA, 61 bp, Homo Sapiens
tggatcttgtctgcactacttaatagtcagsaaggtacttaagtcctgggcccgtttcttc

SEQ ID NO: 126 - DNA, 61 bp, Homo Sapiens
aatatttactaattatgacatttgtaacttrgcaacattattaacatgtcacaaaatgctt

SEQ ID NO: 127 - DNA, 61 bp, Homo Sapiens
cacttcaagagatttaaaacttcaagagatycaaatgcagtgaaaaccatcggggctctca

SEQ ID NO: 128 - DNA, 61 bp, Homo Sapiens
atattgctttaaaatgctgaatgttttactytattgaacagcgaagtttgaaagtagaagc

SEQ ID NO: 129 - DNA, 61 bp, Homo Sapiens
tacaccttatacaaaaattaactcaagatgyaactcaagacttaaatgtaaaacccaaaac

SEQ ID NO: 130 - DNA, 61 bp, Homo Sapiens
gctttgaagtacataatgttttccattcccraaaggacaaagagatctgcattgtcaaaag

SEQ ID NO: 131 - DNA, 61 bp, Homo Sapiens
gatcatttttcattcttacaacaggatttawagctttcatgggctctatcccttgcttatt

SEQ ID NO: 132 - DNA, 61 bp, Homo Sapiens
gcatactacatgtaaaacattgtgctgaggracaagacaacaaggtcccttgtctattgga

SEQ ID NO: 133 - DNA, 61 bp, Homo Sapiens
tttggaaaaggagggtttgtgtgactgctarggagatgttttatattcattggtcatttgt

SEQ ID NO: 134 - DNA, 61 bp, Homo Sapiens
acttagctttcaaaattgtttttggactttmttcagcaaaccaaagtattgcacttgcctg

SEQ ID NO: 135 - DNA, 61 bp, Homo Sapiens
gtaattagctaaagctgagtctcatgaaacmgtatttccttaaaatacacagaggaattgt

SEQ ID NO: 136 - DNA, 61 bp, Homo Sapiens
acatattcataaaagaataaaagcatgattyattgtagtccagtttaaagatggtgtggaa

SEQ ID NO: 137 - DNA, 61 bp, Homo Sapiens
atcaattctcagaccaccagtgctgtaaaakactactccactcttctttttaaaatcccaa

SEQ ID NO: 138 - DNA, 61 bp, Homo Sapiens
ttttaccccaggatctcatcatttccattamaatcagaaattccatctcagttatgttatt

SEQ ID NO: 139 - DNA, 61 bp, Homo Sapiens
acaaacaattttcctctctctttaagaacaytgctccagatgtcttctattaaaagcgaat

SEQ ID NO: 140 - DNA, 61 bp, Homo Sapiens
gacctctctcttcctacatgcagcaagccaraagattttctcggagttttatcctccctgt

SEQ ID NO: 141 - DNA, 61 bp, Homo Sapiens
ttgtattctctggtgcatgttttcgtgctccmagtatttataatgagttaaaagtagcata

SEQ ID NO: 142 - DNA, 61 bp, Homo Sapiens
atattacataagtctcacactaccatttatyacaacaggttcaacaacaattttgacggca

SEQ ID NO: 143 - DNA, 61 bp, Homo Sapiens
tattttaaatgactttcaaaatagagtaacmtaatgctatgtgtttaataaacatgtaaat

SEQ ID NO: 144 - DNA, 61 bp, Homo Sapiens
tctaaatatatatttccatgtgcataaagawatccataaatactaattaaactgcttgtaa

SEQ ID NO: 145 - DNA, 61 bp, Homo Sapiens
gaaggaataggccatacagataggtggaaargctatacagtgaacagctagcccaacatgt

SEQ ID NO: 146 - DNA, 61 bp, Homo Sapiens
tgagtactgagcctctaacgagcttcctggrtagacaccatttcacaggtgttgtcccagc

SEQ ID NO: 147 - DNA, 61 bp, Homo Sapiens
tccgatgggcagaactctgatgtgagctgargcgagttctccaaagataagctaacatggt

SEQ ID NO: 148 - DNA, 61 bp, Homo Sapiens
ccccagctttctaactgtatttgcatgcggwatctttttcaacttttaactttcaaccttt

SEQ ID NO: 149 - DNA, 61 bp, Homo Sapiens
ctttctttccatatgtctttcagtatcaatmtgatttttctgctctttttaatgaagactt

SEQ ID NO: 150 - DNA, 61 bp, Homo Sapiens
ttagtggtgccctaggtgaggtctaatcacygttgagactagggctcctcctgcttagtct

SEQ ID NO: 151 - DNA, 61 bp, Homo Sapiens
gagagtataaatatggcaacctgtcagtccragagtctttattacaaataacagaagctta

SEQ ID NO: 152 - DNA, 61 bp, Homo Sapiens
gcagcatcccccaccttctctctcagatgckcctatcttcctcttatgagaacctttgtga

SEQ ID NO: 153 - DNA, 61 bp, Homo Sapiens
aggatcacctccccatctcaggatctttccrttaatcacatctgcaaaatcttttttgctg

SEQ ID NO: 154 - DNA, 61 bp, Homo Sapiens
ttatttacccactgcttcttatattactggmcttaccactcactgaaatggcgctgaaaga

SEQ ID NO: 155 - DNA, 61 bp, Homo Sapiens
tcttctatatctgcaggataataacctcttytgtttccaaatttctttcttgtatcctcat

SEQ ID NO: 156 - DNA, 61 bp, Homo Sapiens
gtttttatcactgcatttttatgcaaaagaygcaagttggttttttaaaaagcatttgcag

SEQ ID NO: 157 - DNA, 61 bp, Homo Sapiens
ttgcgctaatattaaaattagtttgcattayttgagtgcactatacatatttgtgaagtct

SEQ ID NO: 158 - DNA, 61 bp, Homo Sapiens
acctggctgaaaactagcatttaaccagtawctagtaactctgtgcgagctattggaggca

SEQ ID NO: 159 - DNA, 61 bp, Homo Sapiens
tttttttttttttttttttttggtgaaatgytcttttattacttgctaacagcatttgtta

SEQ ID NO: 160 - DNA, 61 bp, Homo Sapiens
actttcagaaggaccaaccacgaaaaccacyctgatcttttttgttgtcgttgtttgtttg

SEQ ID NO: 161 - DNA, 61 bp, Homo Sapiens
tatagtagggggaattcaggtttatagatgragtctgcctagttctttatctccatagggc

SEQ ID NO: 162 - DNA, 61 bp, Homo Sapiens
ttttttaatgagagaaggcagacttttcaaygtttttagagaaaagtaatcttttttatct

SEQ ID NO: 163 - DNA, 61 bp, Homo Sapiens
aatacatttacccgagcttttgatttgataytgtgttactatatgagaagaaaaggcctgg

SEQ ID NO: 164 - DNA, 61 bp, Homo Sapiens
aatatacttagctaaaataattcttcttcarcaaggctgtctgatgaacttgccctacagg

SEQ ID NO: 165 - DNA, 61 bp, Homo Sapiens
gcagtgcctgacaacatgttaaatatgagartgtaaatgtcaataacttttcaaatcatgc

SEQ ID NO: 166 - DNA, 61 bp, Homo Sapiens
catagaaactagaattccccttcctgaaggygggtcatagaagccagaacccctttcccct

SEQ ID NO: 167 - DNA, 61 bp, Homo Sapiens
atcctactctaattttacttttttctctgtrgcacttttctaatataacatataattgcaa

SEQ ID NO: 168 - DNA, 61 bp, Homo Sapiens
aacgctgcatgctcttacttataaaaagtgsagctcggctgggcgcggcggctcacacctg

SEQ ID NO: 169 - DNA, 61 bp, Homo Sapiens
cccctcttcaccaggctacgaagctacattyccctacctgtggcttacaggccaccaccct

SEQ ID NO: 170 - DNA, 61 bp, Homo Sapiens
catttcgagtttggttcacaaaggcatacarcaagtttattgtgtgtgtgtttattgatac

SEQ ID NO: 171 - DNA, 61 bp, Homo Sapiens
tctcaaaaaaaaaaaaaaaaaaattcaacasaacgattctatacaacacacattctctgtc

SEQ ID NO: 172 - DNA, 61 bp, Homo Sapiens
ttagcctcccaggggacttctggcaaggtcyggagtcatgtttgatctgccaggactgggg

SEQ ID NO: 173 - DNA, 61 bp, Homo Sapiens
ggagggaaaaggaaagtcagatgaggtaatrcgttttagtaaagtgtaaaatgcacgttat

SEQ ID NO: 174 - DNA, 61 bp, Homo Sapiens
acctccatggcctcaggaatcaaagtcctcrgtctctttcacgcggggttcagaaagaaaa

SEQ ID NO: 175 - DNA, 61 bp, Homo Sapiens
gctgtagggcagggtgcttcatttagttttsataggatagcctgtgattggcatcgctatc

SEQ ID NO: 176 - DNA, 61 bp, Homo Sapiens
cgtaatggaagcacacaatgaatgaataaargtaaatgcggatacattctgtactctaaag

SEQ ID NO: 177 - DNA, 61 bp, Homo Sapiens
aacataaaaaaaaatatgcagtagcccagtstccactcttcaccctctcacctgccttcca

SEQ ID NO: 178 - DNA, 61 bp, Homo Sapiens
tgaaaaatacatctaaaaatccccaactagrccagtgcacaaagattcccactgacctcaa

SEQ ID NO: 179 - DNA, 61 bp, Homo Sapiens
acctttatacgaagtcccttccctttgggtrttcacttagagcaacactgaggtccagtcc

SEQ ID NO: 180 - DNA, 61 bp, Homo Sapiens
tgaaactaaactgcccatgtcttgaccgctrattttgagatagtttaaaaatagtatgtgg

SEQ ID NO: 181 - DNA, 61 bp, Homo Sapiens
cagcagccggaggattcagaatcagaatggyggtgaacttctcagcagcagcactggaaac

SEQ ID NO: 182 - DNA, 61 bp, Homo Sapiens
tcaaacccaggtattaacactccaaacccawgttgttgtcattgtgacatttaaaggaacc

SEQ ID NO: 183 - DNA, 61 bp, Homo Sapiens
aaaaacaaaagcacattgtttgatcgagacratgaacaaataaggctggtgtcagatatct

SEQ ID NO: 184 - DNA, 61 bp, Homo Sapiens
acccagcattcgctcgtgtgcctttgcagcrgacagaagactctgcctttgtttcccctgc

SEQ ID NO: 185 - DNA, 61 bp, Homo Sapiens
atttcatcttacaaatgaatagagggctaaygaaaagtctaggtctgtatatatttcacag

SEQ ID NO: 186 - DNA, 61 bp, Homo Sapiens
acggaagggacgtgattgtggctgccttctygggagactcaaattctttggatctgcgcac

SEQ ID NO: 187 - DNA, 61 bp, Homo Sapiens
tatattctatattattttaagagaaagaaargaaatgccaccactggtctacttaaaagca

SEQ ID NO: 188 - DNA, 61 bp, Homo Sapiens
acctaaacactttaagactacttaaaatgcktactgaattttgacattcaagtagtatgtg

SEQ ID NO: 189 - DNA, 61 bp, Homo Sapiens
aggtgaggggatttaattttgaaagattgcrgttttcaccccattcttggaggctttgggt

SEQ ID NO: 190 - DNA, 61 bp, Homo Sapiens
cctgatctattccatgtcaaactggttctcyggagtcttttaaaaattacccttaaataat

SEQ ID NO: 191 - DNA, 61 bp, Homo Sapiens
ggactccagctcgaaggggagcagccgcatktgtcctcagattgtaggcagtgctgtgtta

SEQ ID NO: 192 - DNA, 61 bp, Homo Sapiens
gcagaatcacagtgctctaggtgctgttagrctctaggaactggggggaacgatcccatcg

SEQ ID NO: 193 - DNA, 61 bp, Homo Sapiens
aatctcaatgccccttacgtgatgagtttcmtactccctaattgtaagagtccttcaggca

SEQ ID NO: 194 - DNA, 61 bp, Homo Sapiens
catcaacaagaaccttctttgaaccagacaytgccttatgaattagaatcctttcaagaat

SEQ ID NO: 195 - DNA, 61 bp, Homo Sapiens
tttgttttttaatgaaacagtagttttaaargaaatgcaaccactattgctccttggccct

SEQ ID NO: 196 - DNA, 61 bp, Homo Sapiens
cagggcagggcccgtgccttagacttctccygacccccagagcgctggtacacaggtctag

SEQ ID NO: 197 - DNA, 61 bp, Homo Sapiens
acaggatgcactgagtgataatgacgatatygtattatgtgatgctctgttattttacttg

SEQ ID NO: 198 - DNA, 61 bp, Homo Sapiens
tggcacaaaactctggtaaaaatgtttgccyggagaaggtgtcagataacagacatcaaag

SEQ ID NO: 199 - DNA, 61 bp, Homo Sapiens
gggcaaatccaggaaggcttcatgggggaartgaattttgaacttggccttaaaggatggg

SEQ ID NO: 200 - DNA, 61 bp, Homo Sapiens
atggcagactgtatcaccccccgctagaacrcagaagcttccagaagagctgtcagctgag

SEQ ID NO: 201 - DNA, 61 bp, Homo Sapiens
ctgccatccagagagaacagagtttggaccrtgtccgcagaaggccttggagtgttgacgt

SEQ ID NO: 202 - DNA, 61 bp, Homo Sapiens
gaggcttgggacctgaaggcccattttcccmcagtgatgttgcgaggtaggtgtttagggt

SEQ ID NO: 203 - DNA, 61 bp, Homo Sapiens
acttctatccctccttcctggcactccatartcactttactatgctttgtcttttgctgtg

SEQ ID NO: 204 - DNA, 61 bp, Homo Sapiens
agtgcatggggatgtttctgtatttcttgcrtattccccgcagtgcctagatggtgctgag

SEQ ID NO: 205 - DNA, 61 bp, Homo Sapiens
ctccagaaggaacatccctgccaacacttckacttcagccaagtgagactcttgttagact

SEQ ID NO: 206 - DNA, 61 bp, Homo Sapiens
atgtttggttgggggtgtcaccaaagtaacrgtccattattcaaactggcagacatttgac

SEQ ID NO: 207 - DNA, 61 bp, Homo Sapiens
aattttaaaaaacgtttcttgtctatgcctmcgatgttcttattgacttgagggtttagac

SEQ ID NO: 208 - DNA, 61 bp, Homo Sapiens
agagaaggggagttggaaaacaagacagcgmagcgtcagtttggcagccatggcatccccg

SEQ ID NO: 209 - DNA, 61 bp, Homo Sapiens
acctgatgagctctcagtaaacaaatcactrcgtgcagctgggactgtgcctgggagtgtc

SEQ ID NO: 210 - DNA, 61 bp, Homo Sapiens
aacaatttaatttactgagaagccctacccygggagagcagagagattcaatccttttctt

SEQ ID NO: 211 - DNA, 61 bp, Homo Sapiens
gagtagtttgcttcttttagtttgtccttaytgacaggaggtattcagtattataaactgc

SEQ ID NO: 212 - DNA, 61 bp, Homo Sapiens
tttgatattaccttattgttcatgtcttctrttattatgcagagtgtggagcaaggttatg

SEQ ID NO: 213 - DNA, 61 bp, Homo Sapiens
tgataatcatgggattgttgtgaggattgaygaatacagggaataatgtcaggcacatagt

SEQ ID NO: 214 - DNA, 61 bp, Homo Sapiens
tggggcgcatgcttacaaacagtgcagttcytgggaccgaggtaagcagggctgggtctca

SEQ ID NO: 215 - DNA, 61 bp, Homo Sapiens
ctcagtggcagatagcacctgatgttggccrttatgacagaaattaaatggtcttggtgtt

SEQ ID NO: 216 - DNA, 61 bp, Homo Sapiens
tattgcagcactatttgtactaggaaaaaaytagacatgacctatcattggagaatgaatg

SEQ ID NO: 217 - DNA, 61 bp, Homo Sapiens
atatgtgcctcagcacataccacacaagcayatccatgattttgcttctgtgtgtaacccc

SEQ ID NO: 218 - DNA, 61 bp, Homo Sapiens
cttttatgaaacacactacttcaggtgtttygtataagtggagtcattatagtatttgtct

SEQ ID NO: 219 - DNA, 61 bp, Homo Sapiens
tagggccaaggagcaggtctcaccccaggcrtacttaatcagtgtatcagagggttggatc

SEQ ID NO: 220 - DNA, 61 bp, Homo Sapiens
ttctaatcattcccaaaaagaaactgtgtaygcattagcagtcctcattttcccccaagtc

SEQ ID NO: 221 - DNA, 61 bp, Homo Sapiens
ctacttttccaaccttcttttcttgcctaaygttaggaaaaccaaattgaagatgcctgca

SEQ ID NO: 222 - DNA, 61 bp, Homo Sapiens
agtttccattcttcagctgaactgagtaacyaccctgtgctgtgtcagaaagccagataaa

SEQ ID NO: 223 - DNA, 61 bp, Homo Sapiens
aatattatttgatggcctaaaaaaacttaamactgtctccaagaagaaaaaaagaagtgct

SEQ ID NO: 224 - DNA, 61 bp, Homo Sapiens
ttctaccctgaagccccccatcatgcctcasagacctcggttcattcctgacgatcacttc

SEQ ID NO: 225 - DNA, 61 bp, Homo Sapiens
tagttcctaacctaactttctttactgcackgtggatcttaagcaaacctttttgagtgcc

SEQ ID NO: 226 - DNA, 61 bp, Homo Sapiens
gatcttgttcagccaaagcctcataagttcycctttcggcgcttgtcagagaatgcagtta

SEQ ID NO: 227 - DNA, 61 bp, Homo Sapiens
gagttgggattgaaaggaattgtgcagctasactataagttccaaaaagtatagaaaacgg

SEQ ID NO: 228 - DNA, 61 bp, Homo Sapiens
gttctgaaactgattgtgttgatgattgcasaactctgagcatacactgaaaacaacagaa

SEQ ID NO: 229 - DNA, 61 bp, Homo Sapiens
cctctcgcagtttatctcaccacactgggcrgtgaagcagatggcaacgcccccttggcat

SEQ ID NO: 230 - DNA, 61 bp, Homo Sapiens
tactggctgcagtgtaaagtgactttacagrcaagtgacttttctcttctgaacttcaaca

SEQ ID NO: 231 - DNA, 61 bp, Homo Sapiens
tccagcaaaggaatgctctgatgtattttgyaatatattttgacttcagacaagatacggg

SEQ ID NO: 232 - DNA, 61 bp, Homo Sapiens
ttcaaaaatatttttaaaatagtgacaaatrattaaggttaagtggtatgttaaagcctga

SEQ ID NO: 233 - DNA, 61 bp, Homo Sapiens
attgacatcatattcttattttaggattaaraatgatgatgattcattattttatttgggg

SEQ ID NO: 234 - DNA, 61 bp, Homo Sapiens
tggggtccagtccatgtacagactctgtagsctgtttctcctgtgcagtagccacttcttt

SEQ ID NO: 235 - DNA, 61 bp, Homo Sapiens
ataaagatgacttttcacagtaacagaatcktttggttaatttggtgcggtgggactttct

SEQ ID NO: 236 - DNA, 61 bp, Homo Sapiens
gaaaagatggaactcaactgaagtcttgctmaaaacagatgcagggggcctagacaatttc

SEQ ID NO: 237 - DNA, 61 bp, Homo Sapiens
gaggaccaaggccttgaatgccttgttcacktctgcatccccaacacttaggatgacactc

SEQ ID NO: 238 - DNA, 61 bp, Homo Sapiens
tgtatctggggaaagggccagtaagttccamataagaacattaataaaacaaggaaaccat

SEQ ID NO: 239 - DNA, 61 bp, Homo Sapiens
tttcccagaaatgagataccaaaaggccatrtctcttagggtgccacttggagatagaagc

SEQ ID NO: 240 - DNA, 61 bp, Homo Sapiens
gctaattgagcttctctttctcgcacctgcytaatgaccccactgcagcctgccgccactg

SEQ ID NO: 241 - DNA, 61 bp, Homo Sapiens
actgttcctcttccttggggaccaataataygacactttgcccgggagggggatattgctc

SEQ ID NO: 242 - DNA, 61 bp, Homo Sapiens
aaatgaagacgggagtgcaatgtggagatgyatttacccaaatgtgtgtgggaaggtgggg

SEQ ID NO: 243 - DNA, 61 bp, Homo Sapiens
tttaattctttactctgaaaacctaggactrtaattgtgaacctacctataccgcatgcct

SEQ ID NO: 244 - DNA, 61 bp, Homo Sapiens
atagcttcatcttctgcttccataaattgayagctccactttactaagatcagtaaagtgc

SEQ ID NO: 245 - DNA, 61 bp, Homo Sapiens
ggtgtccgaaacaatcaacctcaccaatatstctgaaattcaactatttatatttccatcc

SEQ ID NO: 246 - DNA, 61 bp, Homo Sapiens
gctgttttgggtgacacttctttatattcartgctcttcttctggaatcaaattccttacc

SEQ ID NO: 247 - DNA, 61 bp, Homo Sapiens
tactatgaatctatttcaagaccaatgaagkctgaagtaagacctaactgttgccttgcca

SEQ ID NO: 248 - DNA, 61 bp, Homo Sapiens
tttttcagctctagagtctcctttccttgckttgctgaggatctcctctatacctggtctg

SEQ ID NO: 249 - DNA, 61 bp, Homo Sapiens
aaagaagctaagcactaaggcagatacaacraaaaggagaaagagagggagttcacaataa

SEQ ID NO: 250 - DNA, 61 bp, Homo Sapiens
ctggctcataccttcctggataagaaatttycaaacactgaatgactgtatagtccatttt

SEQ ID NO: 251 - DNA, 61 bp, Homo Sapiens
ttataaatgtcaccttatttggtaaaagggrccttacagatatgattaagttaaggatctt

SEQ ID NO: 252 - DNA, 61 bp, Homo Sapiens
tgtaagaatattattttagaaaacccaacayaaaactgcaaatacagctccggaagccctt

SEQ ID NO: 253 - DNA, 61 bp, Homo Sapiens
caaaaacaaagtattgtttcgtgcctcagcrtaagtctgaaacaagacatgcatggtaaac

SEQ ID NO: 254 - DNA, 51 bp, Homo Sapiens
tgctgatagaaggtgcagtasatctgcttgtcagtcagctcaggacaggtg

SEQ ID NO: 255 - DNA, 61 bp, Homo Sapiens
ctcaattctcatttttgttcgcatacatacrttttccactgcctcttacagcagtttaaac

SEQ ID NO: 256 - DNA, 61 bp, Homo Sapiens
ttaacaatattaatccttccaatccaggaaygtggaatatttttccattttttagtgtcct

SEQ ID NO: 257 - DNA, 61 bp, Homo Sapiens
acccctgcagagctcaaggactctcaaaagraggctcttagcctggggccaaggcaagacc

SEQ ID NO: 258 - DNA, 61 bp, Homo Sapiens
tctgagaactgataagcatgtgtgtatgtgyggaaagtacctgaggctgaggacagaaaga

SEQ ID NO: 259 - DNA, 61 bp, Homo Sapiens
cctgggttatgcctagggatcacagttatgmttaggattggctcaaggagagttttatctt

SEQ ID NO: 260 - DNA, 61 bp, Homo Sapiens
ttccttggctgtcagtgctgcccagattcasaagaatattgcccacatttcactgtatttg

SEQ ID NO: 261 - DNA, 61 bp, Homo Sapiens
gaagtgaagtctggttattgtttttgcatascagtgttatgcctctgcctgaagttttctg

SEQ ID NO: 262 - DNA, 61 bp, Homo Sapiens
tatttacaaaccacctaccgaatgaaaaatsttgcctagaggtatgaatacttggctgaag

SEQ ID NO: 263 - DNA, 61 bp, Homo Sapiens
taccctggattttcatttcataactctcaasacgtaatttgaaacaaagagtcaccatcca

SEQ ID NO: 264 - DNA, 61 bp, Homo Sapiens
tatgatctcggtgtagtgcatttgttataayagaaagatgcaacacagtcaaagacaaagt

SEQ ID NO: 265 - DNA, 61 bp, Homo Sapiens
taaaaattcctttcagtagtggaacgaaatractttggagaaaaggaaaatgattttggaa

SEQ ID NO: 266 - DNA, 61 bp, Homo Sapiens
catgcctggctttgtttcctttttattccckagtagtattgcgttgtataaatatggccac

SEQ ID NO: 267 - DNA, 61 bp, Homo Sapiens
acaaattttaggctaaacttatcaatgtctrctaagaagtctactacaattttgattggat

SEQ ID NO: 268 - DNA, 61 bp, Homo Sapiens
cgactctttgcactttaaaaaagatattagmaaccacagaagaaaaaaaaaatttttttaa

SEQ ID NO: 269 - DNA, 61 bp, Homo Sapiens
tactgtgatgaacaatagcgaaaagctctgraagtgattaacaaagataatgaggtgacag

SEQ ID NO: 270 - DNA, 61 bp, Homo Sapiens
gtatggtataccaaatgtccattacaccttyagtctcagattttctttctcatcttcactc

SEQ ID NO: 271 - DNA, 61 bp, Homo Sapiens
atatttgttctactgatcatcctggtttcartagaattatcctaggagtgagcagtaatca

SEQ ID NO: 272 - DNA, 61 bp, Homo Sapiens
aatatatggtctggtttgggccacaaattcratataatacaaatctagtatattttgtagc

SEQ ID NO: 273 - DNA, 61 bp, Homo Sapiens
tcttataagaaacattctggctacaaaacakcttttcgtatacaaacttatgaaaacccta

SEQ ID NO: 274 - DNA, 61 bp, Homo Sapiens
acatgctatctataatgaccttgggtatctscttaacctcacagagcctttgtttaatcat

SEQ ID NO: 275 - DNA, 61 bp, Homo Sapiens
ttagactttaagcccactaggcagcttcagyagtattttaaagcttttgccatacatatga

SEQ ID NO: 276 - DNA, 61 bp, Homo Sapiens
tctaagaaattatttcatggatttcatttckgtcgcctcaaaaaatactaaattgctcaag

SEQ ID NO: 277 - DNA, 61 bp, Homo Sapiens
gccatgctcacctgcactgtgccttttaacytctattatcatctgcctctagatcccttag

SEQ ID NO: 278 - DNA, 61 bp, Homo Sapiens
ttagggatattataacagaattacataaaaygaggagaataaaaggaaatcaactattcta

SEQ ID NO: 279 - DNA, 61 bp, Homo Sapiens
tacgcatatacataatcattagtgaaaaatmtgtttacagaggtgaattacatgtcacatt

SEQ ID NO: 280 - DNA, 61 bp, Homo Sapiens
acaaagttcacccagttaaatggtacaactyaatagttttttgtgtatttacacaggtgtg

SEQ ID NO: 281 - DNA, 61 bp, Homo Sapiens
aacaaaatggaaaattattctggctaagaawctacttttgatgtaattaccctaattcagt

SEQ ID NO: 282 - DNA, 61 bp, Homo Sapiens
caaatatttgaattacacaaggcaccatttmggttacaagactggtagcatacagcatgtt

SEQ ID NO: 283 - DNA, 61 bp, Homo Sapiens
aagtcacaaagctacaaagtcctaatgctakatctgtgtctccaaacccagattaatctga

SEQ ID NO: 284 - DNA, 61 bp, Homo Sapiens
gtaagactgaacagcacaaacccctgaaagyagaccttttcatcttaaatgtactggcaga

SEQ ID NO: 285 - DNA, 61 bp, Homo Sapiens
gatttcaatctacttaaatttgttaagaccrcttttgatggcctaacatgatttatactgg

SEQ ID NO: 286 - DNA, 61 bp, Homo Sapiens
actttccccttcagaatattcctaaacgatrcattttgatttgaagggtcctgttcgtagg

SEQ ID NO: 287 - DNA, 61 bp, Homo Sapiens
aaagtaaaacccttcaaaaatatgcacttartcattacaatttcgtaattttctttaacac

SEQ ID NO: 288 - DNA, 61 bp, Homo Sapiens
actaaatactctgtatttaaggattattcamtgttctttactttgagttactaggtattca

SEQ ID NO: 289 - DNA, 61 bp, Homo Sapiens
ttcccaatagaccatcaatatcttaggacaragcaatctcttatattctatcctctttact

SEQ ID NO: 290 - DNA, 61 bp, Homo Sapiens
tactattaactttttcacatatcttagaacktaaaagtaatctggcttgctgatagagtgt

SEQ ID NO: 291 - DNA, 61 bp, Homo Sapiens
atggggataatgagagtaactatcacaaagsgatgttaaacattaaacttaatgaaacatg

SEQ ID NO: 292 - DNA, 61 bp, Homo Sapiens
gattaatacctagatatttgctctgctattycccaccaatgtggctataggtttacattta

SEQ ID NO: 293 - DNA, 61 bp, Homo Sapiens
ggattacaggcgtgagccaccacacccagcygagacatacaatttaagacatacaagttac

SEQ ID NO: 294 - DNA, 61 bp, Homo Sapiens
atctgtatgaaattttgaaagacatgatgtrtagtcaacttacaatgggcttcattatact

SEQ ID NO: 295 - DNA, 61 bp, Homo Sapiens
cactctattatgctgaagtatctcatggtgstttgtgatagcattaagagttcatctatcc

SEQ ID NO: 296 - DNA, 61 bp, Homo Sapiens
ctgctgaaagtgttgaaatttctcaaattastcacagattgcaattttctccatatacatg

SEQ ID NO: 297 - DNA, 61 bp, Homo Sapiens
actatagtcagcttctgtatttggtgtattrgatgagtatgacaatttgcctcccctcaaa

SEQ ID NO: 298 - DNA, 61 bp, Homo Sapiens
ggctcagcaattatcctagcatcatttaccraaaagttcatctttgtctcaatgatttgac

SEQ ID NO: 299 - DNA, 61 bp, Homo Sapiens
  misc_feature (31)..(31): n is a, c, g, or t
ataagccatctgcttagagtcacctgaacantgagaatttagagtcttcatgctcaggttt

SEQ ID NO: 300 - DNA, 61 bp, Homo Sapiens
accctgttcctacaaaaatttaaaaaattasttgagcatagtagtacatgcctatagtccc

SEQ ID NO: 301 - DNA, 61 bp, Homo Sapiens
cattacattatttgatctaaccaactcctaygccataactagtgttattcctattttatgg

SEQ ID NO: 302 - DNA, 61 bp, Homo Sapiens
ctatggcaagggtggcttgatggcaacaccktcaaacatttttatccatatacatttgatc

SEQ ID NO: 303 - DNA, 61 bp, Homo Sapiens
ttgttttctggaagcaaaagactgctattasacagagacagacatgggaaggatgagaatt

SEQ ID NO: 304 - DNA, 61 bp, Homo Sapiens
aaatatcaattaagtcaagttattgatagtrttgtttaagtcatctgtagctttgcttatt

SEQ ID NO: 305 - DNA, 61 bp, Homo Sapiens
agctgttcactcctaagtcagacgttgaatstaacctcagtgctgtttctagtcactaaac

SEQ ID NO: 306 - DNA, 61 bp, Homo Sapiens
acaattgagtttttctacttgagagcagtayattaaatgctttgaccaatgtctgttatgt

SEQ ID NO: 307 - DNA, 61 bp, Homo Sapiens
tattttcttgtaaattagtagagaccattayacacttgaacccaaggttcaaccagcaatg

SEQ ID NO: 308 - DNA, 61 bp, Homo Sapiens
tggaaattaaactttttcccccttttgatayttataggcttcttcagtgttgggcaaagat

SEQ ID NO: 309 - DNA, 61 bp, Homo Sapiens
tgacaagtcttctggggaactgaggagctcrgtggtgaacctgtatcttgccatccctgca

SEQ ID NO: 310 - DNA, 61 bp, Homo Sapiens
ttttacaataccttcgtgatgacaccggagkcaggcaaagcagtgagggttaagtgagttg

SEQ ID NO: 311 - DNA, 61 bp, Homo Sapiens
cgggttctgcctgcctggactccctctcacrtgctggttgacacagagacaaaggtggctc

SEQ ID NO: 312 - DNA, 61 bp, Homo Sapiens
tagagaaaccgaggaactgaactttatacartgtagttttaattaatttaaatgtaaatat

SEQ ID NO: 313 - DNA, 61 bp, Homo Sapiens
ccagaccaggaggcttgagcccttcagcatsttatagctgaggaaggagacagagctcgag

SEQ ID NO: 314 - DNA, 61 bp, Homo Sapiens
cagcgtttggataagccttacctgactgtaygaacttgtagataaacgaagaagatctctg

SEQ ID NO: 315 - DNA, 61 bp, Homo Sapiens
tatgttgcactgcaaaacaaaacacgctaaygttgcataatgaagtggttcccaggattta

SEQ ID NO: 316 - DNA, 61 bp, Homo Sapiens
aggtagagtgcttccgatctgcttttaccaygtgagtttcacaactcttcttaaaattgtt

SEQ ID NO: 317 - DNA, 61 bp, Homo Sapiens
cagtaaataatctgtatctattttcatttarcattgtatctatgaaattcatgcatgtttt

SEQ ID NO: 318 - DNA, 61 bp, Homo Sapiens
gcagacacgagccagagttccttgcttgagraagaagacattaagaaacatttatttgttt

SEQ ID NO: 319 - DNA, 61 bp, Homo Sapiens
agaactccttataaagtgtcaagggacgggrtatgtgtaacaaggtaggaagaaggactaa

SEQ ID NO: 320 - DNA, 61 bp, Homo Sapiens
caaaggatggttcaatgttgcatacagttgrgttgccatgagagacaattatggccatccc

SEQ ID NO: 321 - DNA, 61 bp, Homo Sapiens
atgggtcaagttccatattttactcaaatgycttgggtgagaacagaataagcagaactgt

SEQ ID NO: 322 - DNA, 61 bp, Homo Sapiens
ccaggcttggtctgactcatgcagagtagaycagcactatcaccttctataattctattaa

SEQ ID NO: 323 - DNA, 61 bp, Homo Sapiens
ctaaaaacaaaactctcacagctaatacgcstctgggccaaaacttgaacctgtgtgattt

SEQ ID NO: 324 - DNA, 61 bp, Homo Sapiens
ttgccacccactcccacaagtaatatctccragttctgagaatctaagaatgtgttctaca

SEQ ID NO: 325 - DNA, 61 bp, Homo Sapiens
ccaaatgctcattgctaactcaccctcttaycttcttgccccaccatagtatcagtggaca

SEQ ID NO: 326 - DNA, 61 bp, Homo Sapiens
cattctgtaggtgtatgggagacagggcagwtgagtattgagggacaggtcctagagggtc

SEQ ID NO: 327 - DNA, 61 bp, Homo Sapiens
aatgattctggatccaatgtctgttagattktcaaggttcctacaggaatacctctagaaa

SEQ ID NO: 328 - DNA, 61 bp, Homo Sapiens
cagaggtaggtgaattatctccacagctctmtgataatgacaggcattatcagtcattagc

SEQ ID NO: 329 - DNA, 61 bp, Homo Sapiens
ggagttctttatatagtctggatattagcaycttatcagacagtgattggcaaatattttc

SEQ ID NO: 330 - DNA, 61 bp, Homo Sapiens
agccttttacaaagataggaagcattatgawgacattttccaaatggcctcaagaaactga

SEQ ID NO: 331 - DNA, 61 bp, Homo Sapiens
aaaataaagaaaaattgatatggaattccayagagcatcctggaagtatgacaaaccttca

SEQ ID NO: 332 - DNA, 61 bp, Homo Sapiens
aaatgaatgaacaaatgaatgaatggtgaakaagcatctgttgggtgggtgaggtgttatg

SEQ ID NO: 333 - DNA, 61 bp, Homo Sapiens
aggcatcagtgctcaaggcacctaggctagygagtctcatgcactttcctccatgcagctt

SEQ ID NO: 334 - DNA, 61 bp, Homo Sapiens
caccagctggaagctaatctccacaacaatyggctcacagacatttcataaatgtgttcaa

SEQ ID NO: 335 - DNA, 61 bp, Homo Sapiens
aataaattgcagcagctcatgtatagaaggwctccattgctatttaacttcttgtttggat

SEQ ID NO: 336 - DNA, 61 bp, Homo Sapiens
cagaactaataagaaaagagatgggattcayagattttctgtctgtaaatcccaggccagc

SEQ ID NO: 337 - DNA, 61 bp, Homo Sapiens
cagtgtaattagtgccctcagccaattgccrtttctcaccgctttgtagctgtatttacta

SEQ ID NO: 338 - DNA, 61 bp, Homo Sapiens
gtctataggaagggtaggaggtgtggtacartagaaattccagacagagagaaatggagat

SEQ ID NO: 339 - DNA, 61 bp, Homo Sapiens
aataatccagtgaagagatggtgagtgtctraactagggcttatggcattagggatgagga

SEQ ID NO: 340 - DNA, 61 bp, Homo Sapiens
gcagaccttcaggacatcctatgttaatccracagcagtttatggattcatgaaaagacca

SEQ ID NO: 341 - DNA, 61 bp, Homo Sapiens
tggcactggcagatttctttcttcttaactycttatatgtcagctttactacccgtaatgc

SEQ ID NO: 342 - DNA, 61 bp, Homo Sapiens
gagggctagaacaagtcatgggaagtgagcrgctaaggctggttctctggctgggacaatc

SEQ ID NO: 343 - DNA, 61 bp, Homo Sapiens
ggtgcagtgtggggatttggatgcagcaggytgagttttcttaagctatttatcctgcaca

SEQ ID NO: 344 - DNA, 61 bp, Homo Sapiens
ttattcctaaaatattctgtgactgttgccygtcagatatcagagaaaagagaattactct

SEQ ID NO: 345 - DNA, 61 bp, Homo Sapiens
aggaaagacagaagtggatgaggtaaggtgratgagaggaaaacagtgttagagccgggtt

SEQ ID NO: 346 - DNA, 61 bp, Homo Sapiens
ggtaactggatcacggtgatgaatttctcayggatggcttagcataatcttcttggtgctg

SEQ ID NO: 347 - DNA, 61 bp, Homo Sapiens
tatgtttcaaaaattgaaccaagtcacgttygagaaacattacacatacggtattttaata

SEQ ID NO: 348 - DNA, 61 bp, Homo Sapiens
gaaaacggggtgtctgtaggctagagtagayagggaaatcttttttttttctttctccctt

SEQ ID NO: 349 - DNA, 61 bp, Homo Sapiens
tgattgttcactctgtagatttgccatcaaycacaattgcagttagatttactggttttgc

SEQ ID NO: 350 - DNA, 61 bp, Homo Sapiens
caactccttttagatacattctagtgtctcrgcttggagtagaaggaagggatccttgaaa

SEQ ID NO: 351 - DNA, 61 bp, Homo Sapiens
ttatagaggcatcaacttgtgcagttgagtraaatttgtcttttccagcctagtttcccta

SEQ ID NO: 352 - DNA, 61 bp, Homo Sapiens
tttttattattgagctctatttcctcttccraccttcaatctgtacatgtccattttaggt

SEQ ID NO: 353 - DNA, 61 bp, Homo Sapiens
gattggaatcactgggtaataggataggtgyaactttataagaaacagctagagctttttg

SEQ ID NO: 354 - DNA, 61 bp, Homo Sapiens
aagctattaaactagaaatatatagaacctstagaaattcagtgcatttaaaacattttaa

SEQ ID NO: 355 - DNA, 61 bp, Homo Sapiens
aatagaataaagacaacagtcatttcagctrtagcagtcacaagatgagtatttttaaaaa

SEQ ID NO: 356 - DNA, 61 bp, Homo Sapiens
aaaatgcaacaggatctaaactaactgaaaygaaaagcagcagaagttattaacctttttt

SEQ ID NO: 357 - DNA, 61 bp, Homo Sapiens
aattaaaacaaaaaacattaaaagaaggatkccatgtctgaagtgatgaaaacaaaactat

SEQ ID NO: 358 - DNA, 61 bp, Homo Sapiens
aaacaacgagttatgcctctcatggaactcrgagaggaaagcaaactgggagactaactga

SEQ ID NO: 359 - DNA, 61 bp, Homo Sapiens
attctttttgctggtgaatcacttgaaaccrtcgtcctcaaactttttggttgcaggacca

SEQ ID NO: 360 - DNA, 61 bp, Homo Sapiens
caggttgcatctatttatggttccattcccygaactgatccaataaagcttgttttccaca

SEQ ID NO: 361 - DNA, 61 bp, Homo Sapiens
acatcataaagcatccttacacaaaccgagmtagtagagcctgctgtgcacctaaactata

SEQ ID NO: 362 - DNA, 61 bp, Homo Sapiens
tgagagaaaagaaggagttcacagccatttktcatgcaacagaagaatggaatcgtagttg

SEQ ID NO: 363 - DNA, 61 bp, Homo Sapiens
agtgctcaggaaaattaagtgtcaataagtraaggcaaaattaaacttctttttctaagca

SEQ ID NO: 364 - DNA, 61 bp, Homo Sapiens
cataccaccttgaatttgtgtaaaaaggtgrtccttcagttcacagagtttaggggctttt

SEQ ID NO: 365 - DNA, 61 bp, Homo Sapiens
gcctgtttagaaaatgtaaggtttgtgccamatattaatagctttatgcaaggtaagtatt

SEQ ID NO: 366 - DNA, 61 bp, Homo Sapiens
tatacatttttaaagttgataaagactcagrtagggttcctggtattacaaatgcaaaata

SEQ ID NO: 367 - DNA, 61 bp, Homo Sapiens
ttcctacattcatgcctgtaatgacaggaakgtaaaggttaagtgggtaggactacgactt

SEQ ID NO: 368 - DNA, 61 bp, Homo Sapiens
gtaccccagaatagagcctctctcagcatargatttccagagattatgctggaaataatgc

SEQ ID NO: 369 - DNA, 61 bp, Homo Sapiens
ctgaaattatgataaagaatatcagcattcmaattatttgcaaactcatcatgtttctcct

SEQ ID NO: 370 - DNA, 61 bp, Homo Sapiens
ctctgagtttaggtcagaaaaagtccaaaayattcagtctaagtagctgtctattctcacc

SEQ ID NO: 371 - DNA, 61 bp, Homo Sapiens
gtggattggttgccaaaacaagcaggagctrgccagtttacttttggactatactgcatag

SEQ ID NO: 372 - DNA, 61 bp, Homo Sapiens
agagaaaacatcattcattccgtctttgcckcaccaaatatacattatgctgcttgcgtat

SEQ ID NO: 373 - DNA, 61 bp, Homo Sapiens
gtttttctcccattatggagctaagggtctmgaggcaaacagaggaggaggaataaacaga

SEQ ID NO: 374 - DNA, 61 bp, Homo Sapiens
tctaatgatgccagagaaaacaattctgtcstaattatatggggagtcacaaaacacaccc

SEQ ID NO: 375 - DNA, 61 bp, Homo Sapiens
ctcatcttaattgttttctagacagatggamgtggtatgaaagccaataaaactaaaaggc

SEQ ID NO: 376 - DNA, 61 bp, Homo Sapiens
taacttgtcctaaggttgcttgtctttgtcyagtaaatggcaaacttgggttctaacacaa

SEQ ID NO: 377 - DNA, 61 bp, Homo Sapiens
catcttccaattcatagatgtcatcttctawgtcctcacatgttggaaagggtcatttagc

SEQ ID NO: 378 - DNA, 61 bp, Homo Sapiens
atttgaggagttgttcctaaattagaactcmattttctcctctgcacatacagcattgact

SEQ ID NO: 379 - DNA, 61 bp, Homo Sapiens
aaatttgtaagtctaatacagagtttccatwtacccttcaaccaattccccagatactaac

SEQ ID NO: 380 - DNA, 61 bp, Homo Sapiens
ttcatcctcgtattcttctttccgaacccayatcctgccataatggcccagtcgaaatatc

SEQ ID NO: 381 - DNA, 61 bp, Homo Sapiens
cacagttaaagtcatttgggcagaaaatgtygacccgttggaacagaccataaacctgctg

SEQ ID NO: 382 - DNA, 61 bp, Homo Sapiens
aataatttttagtaattgcatatgattacastaccattataatccaattttagaacatttc

SEQ ID NO: 383 - DNA, 61 bp, Homo Sapiens
atatagcagatgtagatttatccattatcamgattattctaacaaatttttaccctcttgc

SEQ ID NO: 384 - DNA, 61 bp, Homo Sapiens
tattataattctctaacaatgagtagtaaakggagtcagagtactctggatgtggaaaata

SEQ ID NO: 385 - DNA, 61 bp, Homo Sapiens
aatattcatggaatattttggaaacaaccaygttggaaagggcatttgagtaatattaaag

SEQ ID NO: 386 - DNA, 61 bp, Homo Sapiens
ccatgaagaatgtgcaatttgtactgttaartttgtgatgagattcttgaaaacttttatg

SEQ ID NO: 387 - DNA, 61 bp, Homo Sapiens
agtagggaagatgtttttgtcttttcagctstattccagataccttatatttctgtctcca

SEQ ID NO: 388 - DNA, 61 bp, Homo Sapiens
ttgttggtgtgagccactgaacctggcctaraatagaactgttaacaataactgtctttgg

SEQ ID NO: 389 - DNA, 61 bp, Homo Sapiens
tctttataaaagcagagattagtcttttcaygctacacacgctcattcatgactttccttt

SEQ ID NO: 390 - DNA, 61 bp, Homo Sapiens
tctcattgatgaggaaattagtacaattatwcttccttccagatagtcttccaagttattt

SEQ ID NO: 391 - DNA, 61 bp, Homo Sapiens
ttaggaacaagagagtctaggaaccatgagrccaaggtatagaatgggtcatccatgtggt

SEQ ID NO: 392 - DNA, 61 bp, Homo Sapiens
ccaagatactagtcaaggagatctggagtaraagttctagtagacccctctagctatgctg

SEQ ID NO: 393 - DNA, 61 bp, Homo Sapiens
acaggtgtctctgtaattgtgatacgttggkaaaattcacactgttaaatgagcctcaaat

SEQ ID NO: 394 - DNA, 61 bp, Homo Sapiens
gttgatgttttgaattaagtcaaagaaaaamgcattaacaagtgtaccaaacttggtgact

SEQ ID NO: 395 - DNA, 61 bp, Homo Sapiens
ggggtatacttacccaatgtggttagttctyaaagaaatttccagttctcttagcacttgt

SEQ ID NO: 396 - DNA, 61 bp, Homo Sapiens
aacttattatttgttggagtttgaaacttastgaaggtttaatcaggtaccatatgttgtt

SEQ ID NO: 397 - DNA, 61 bp, Homo Sapiens
aggctgtagatcaattgtggtggaaaaagtrcattaagcaagtgccttctttaaagaaagt

SEQ ID NO: 398 - DNA, 61 bp, Homo Sapiens
tatttgctccctttaggctgtgtggcactaygaagagcctgggataagcaagggggccttt

SEQ ID NO: 399 - DNA, 61 bp, Homo Sapiens
gcatttgggtacaagtaattgcgtaaaacaygaaaggacaaaaccttagaccaagacaact

SEQ ID NO: 400 - DNA, 61 bp, Homo Sapiens
aaaaatccttgctccttgacagaaagaatcyttgctacttgtgttcaaacgctgcgttttt

SEQ ID NO: 401 - DNA, 61 bp, Homo Sapiens
ttccagcaggcagcagggtagaggattgatwtgaagtgggagagcgtgggaggcctatgaa

SEQ ID NO: 402 - DNA, 61 bp, Homo Sapiens
tgaattgtttttcaaaaacataaacatagaytgaaccatttctagaagatttcccagtttt

SEQ ID NO: 403 - DNA, 61 bp, Homo Sapiens
gtgatttgaattcattttgtccagcagataytagtgagaagctcggccactgcttcatggc

SEQ ID NO: 404 - DNA, 61 bp, Homo Sapiens
gtgaacagaggcacatcttcaaaggtaaaamggtgtgctgaagtagatcagggaggggtgt

SEQ ID NO: 405 - DNA, 61 bp, Homo Sapiens
cagagaatgtcagaatacagagaatgtgagycatactgcagcatgactgaaaatgactgac

SEQ ID NO: 406 - DNA, 61 bp, Homo Sapiens
ccattgagatggaatccttaaagattgtttycagttaaaatcctaggccttccctgagaag

SEQ ID NO: 407 - DNA, 61 bp, Homo Sapiens
agaattttggataagcgatactcagcctgtrtaagaatttgtacttctgtactggcagaca

SEQ ID NO: 408 - DNA, 61 bp, Homo Sapiens
gggtctttttctgtgtggattttgctttagmgtccatgagagtaagaaacttctttaaccc

SEQ ID NO: 409 - DNA, 61 bp, Homo Sapiens
ttcatggattccagtttttcacccataaagytctactggcacatttccataactgcgtagt

SEQ ID NO: 410 - DNA, 61 bp, Homo Sapiens
tctgaatatatttttctaggaccactgttaygatttaacttcatggactccattcctattt

SEQ ID NO: 411 - DNA, 61 bp, Homo Sapiens
attttgtcctcttccaagttacttggataawtacaatgcatagctaaaatataatggtcta

SEQ ID NO: 412 - DNA, 61 bp, Homo Sapiens
tgggaagatgtctgtgttctgctgcccttargcctgtcggggatttgatcacaagctcagg

SEQ ID NO: 413 - DNA, 61 bp, Homo Sapiens
aaatgtcttacaagcatgttaaagtacccaraatccatccaactgaaataatttgacccat

SEQ ID NO: 414 - DNA, 61 bp, Homo Sapiens
attaagacctgtaacatacttagcactgatstaagctctgatacagtcattcagtaatgtc

SEQ ID NO: 415 - DNA, 61 bp, Homo Sapiens
ttctgggccttggaggccgtgttaaggagtwgttttcatcctaagagcagtaagaaaccgt

SEQ ID NO: 416 - DNA, 61 bp, Homo Sapiens
aataccttaaagctacatctatgaagtttgyacataagcatgtatgtttcaatctgagaaa

SEQ ID NO: 417 - DNA, 61 bp, Homo Sapiens
gtctgtgctgcccaatatagcagagattaaytagccttgtgtagctattgagtatttgaaa

SEQ ID NO: 418 - DNA, 61 bp, Homo Sapiens
cttgaaaacagaataaatgtacttagctcayagaggtaatgtgattccaatttagctggtc

SEQ ID NO: 419 - DNA, 61 bp, Homo Sapiens
attctaggacaactgctagagcttttgaagraaacctgggccttttttctttcttctttct

SEQ ID NO: 420 - DNA, 61 bp, Homo Sapiens
cctggatgtaagggagagtctgggtgacttktagttttacaggagctgatgataagcaaag

SEQ ID NO: 421 - DNA, 61 bp, Homo Sapiens
ctccacccaatttaacaactaaaaactcctktggcagtgatagaccaaacatgaatttgaa

SEQ ID NO: 422 - DNA, 61 bp, Homo Sapiens
aaataaaatatttaaagatgtatgctacctraaatgatgactctaaacagttttatctgtc

SEQ ID NO: 423 - DNA, 61 bp, Homo Sapiens
cattttgcttaacccatgaatgttataagaraccagttgagaaaatcttggacactgaaag

SEQ ID NO: 424 - DNA, 61 bp, Homo Sapiens
gattttttctgccagcatatttcttgggagyaacacttaacatttttggttctttctcaca

SEQ ID NO: 425 - DNA, 61 bp, Homo Sapiens
tacctcagcttcttcttgctcttttttaagwcggtctaacatctgttgaaattctaattct

SEQ ID NO: 426 - DNA, 61 bp, Homo Sapiens
ggaataaaagaaaagtagagataataatcarttctttacaaccgatggtaattaagcttgt

SEQ ID NO: 427 - DNA, 61 bp, Homo Sapiens
atccatgatgctagcagaatctgtgatggakaaaggcgtagtatggagtatctggcaagcc

SEQ ID NO: 428 - DNA, 61 bp, Homo Sapiens
gtataactgatggaaaatagtactgatacaaytgcaatggttgagggtataattttcaaat

SEQ ID NO: 429 - DNA, 61 bp, Homo Sapiens
ttccatcaatgtgataaagtcacaaccacaytgatggaagatgaattttatggcatgtgaa

SEQ ID NO: 430 - DNA, 61 bp, Homo Sapiens
gctaccaaaccatctaccacacgaggctacrgagacagaatgcccagttttgaagtgcttg

SEQ ID NO: 431 - DNA, 61 bp, Homo Sapiens
aatcagtaattgagcgggaagtccaatgaasaagtctttgggatttagaactacaaaactt

SEQ ID NO: 432 - DNA, 61 bp, Homo Sapiens
tatagcatttcagctgcactgtaggttaaaytggctctttgggctaatccaaactgtaatt

SEQ ID NO: 433 - DNA, 61 bp, Homo Sapiens
agaatgttggatttgtttcttaaaggcacargtaaacaaaccagtctgtggatggcactgt

SEQ ID NO: 434 - DNA, 61 bp, Homo Sapiens
tcctttccccatccatggtcaataaccttcracagctgatctaaaaaggtcgcctattcta

SEQ ID NO: 435 - DNA, 61 bp, Homo Sapiens
gcttgctaatacgacttaagagactctacayagccttatcccagttattacagacctcctc

SEQ ID NO: 436 - DNA, 61 bp, Homo Sapiens
atcatcaggcttttagatctgtatgtcttaycaaaaacagacaagctatgttattaaagtt

SEQ ID NO: 437 - DNA, 61 bp, Homo Sapiens
aataaataaataacaaaaaactcagcaattrtggaaattaatcttaaattttagcttattc

SEQ ID NO: 438 - DNA, 61 bp, Homo Sapiens
ccatccgattcttgataggttttattgagcractttataacgtaaaactgcttttagagag

SEQ ID NO: 439 - DNA, 61 bp, Homo Sapiens
tatccccaaaagtgattgtaaaacaccattyatatgacacatgatttcagagacattacaa

SEQ ID NO: 440 - DNA, 61 bp, Homo Sapiens
taatacctattgaactatcctactaaatgayattttgatgaccgtcaaggatgaagtgggc

SEQ ID NO: 441 - DNA, 61 bp, Homo Sapiens
acagggttaccctgaaaaccaacccgaacartacaatgatttcatccgtttgagggtgact

SEQ ID NO: 442 - DNA, 61 bp, Homo Sapiens
taacattttgacaaaagaaaggacatcttamaaatgaattcctgaatgtacggatagaaaa

SEQ ID NO: 443 - DNA, 61 bp, Homo Sapiens
aagagcaaagattatgagagcattttgtctrtttaaatgaatgtagcagtccaaacactga

SEQ ID NO: 444 - DNA, 61 bp, Homo Sapiens
ttttagcctgcttatgaaggacaactctacwtaaagccctataaaagatcccaaactagtt

SEQ ID NO: 445 - DNA, 61 bp, Homo Sapiens
ccagacacaattctatgaaacgttgttggtkgagtctttactttcagtctgctgacagtga

SEQ ID NO: 446 - DNA, 61 bp, Homo Sapiens
aaaatcatatcctataatatgtattgttcayttagtacattgaaagaaaaagctgtatttt

SEQ ID NO: 447 - DNA, 61 bp, Homo Sapiens
cagaaagctgttacagcattttagacaactytcccctacacattcctttccaaacaccctg

SEQ ID NO: 448 - DNA, 61 bp, Homo Sapiens
accactaaattgcagcttgcagtttaaaaawttttgctttagtgtactaattacctgtgta

SEQ ID NO: 449 - DNA, 61 bp, Homo Sapiens
ggaaccagcattggaaagtccttcaattctsgtactgtaattaaatccttttctacttggt

SEQ ID NO: 450 - DNA, 61 bp, Homo Sapiens
agactagtatctgagagcaagcaattgatgytctattccatattcaatcttatcaccccaa

SEQ ID NO: 451 - DNA, 61 bp, Homo Sapiens
tcacatgccaaccttgctactctatccaacsccagcaaagtaaaaaccaggcttacactca

SEQ ID NO: 452 - DNA, 61 bp, Homo Sapiens
ttcaatctccccaccaattggcttaaatgcrgccagttgggcggccacttctgtctcaaaa

SEQ ID NO: 453 - DNA, 61 bp, Homo Sapiens
tagcatgggcgactcaagtatattagtttgygctgattttttttaaagctttgcagtattt

SEQ ID NO: 454 - DNA, 61 bp, Homo Sapiens
attgaagtgtattttcctctcatgcaccaaygtgaatggaagcaatcctgattgacatggt

SEQ ID NO: 455 - DNA, 61 bp, Homo Sapiens
agtgctgacttccagcttgtaggatttgacrtagtagccattctgtgtttccctggaaatc

SEQ ID NO: 456 - DNA, 61 bp, Homo Sapiens
gcccatccccaacaaactgaatttctcctcrttatttattgtcctttttcttctccaggac

SEQ ID NO: 457 - DNA, 61 bp, Homo Sapiens
acagggaaagggacacttctttttctaatgygtgaaagcctccattgaggtaacccaagct

SEQ ID NO: 458 - DNA, 61 bp, Homo Sapiens
aagatagtggggaacaacttgttgatttgartagttgtcataggtcatgaagtgtagcttg

SEQ ID NO: 459 - DNA, 61 bp, Homo Sapiens
ctaggttgtgccagtgaaaagtccctgtttrtgcctccaacattcttctctctgttacgat

SEQ ID NO: 460 - DNA, 61 bp, Homo Sapiens
caaatcacaaactgaccatggtcaaagagawaagattaaggtgacacagcaattgcaggag

SEQ ID NO: 461 - DNA, 61 bp, Homo Sapiens
gcaatcttcagaggtccacactgaaatgtgrcaacaggtaggggagacccagccattgccc

SEQ ID NO: 462 - DNA, 61 bp, Homo Sapiens
aggaaagtactttgcaagaaaaaattgtttygggaactacattcttaagccaatggtgaag

SEQ ID NO: 463 - DNA, 61 bp, Homo Sapiens
cgtggaaaaaattccaagacgtgtatacttkccaaacaagaaaagaattaacattttcact

SEQ ID NO: 464 - DNA, 61 bp, Homo Sapiens
gttgcactaaatactaggaagtgtagaaagytggattctgttggaagccctgccttctagt

SEQ ID NO: 465 - DNA, 61 bp, Homo Sapiens
caatgtaagcaagagttgtggccaggcaaaygtccttggaaagccttaccctttagagata

SEQ ID NO: 466 - DNA, 61 bp, Homo Sapiens
tgctaagtccttgctaatttcccacctctcwaacgcatagttagaaaaagtcaataggaag

SEQ ID NO: 467 - DNA, 61 bp, Homo Sapiens
cagaacaataaaaaccttagagatgtatacrtaaatatcacttgcttaggaatttctaggt

SEQ ID NO: 468 - DNA, 61 bp, Homo Sapiens
atgaatgctttcctagaatcttccttctggratcctactttttatgtagtttggagattct

SEQ ID NO: 469 - DNA, 61 bp, Homo Sapiens
aaaatgcattatgcagagtttctagcagatrataacagtgacaattgcagagtactgattt

SEQ ID NO: 470 - DNA, 61 bp, Homo Sapiens
ccaaggtctggcagggtcttgccttcccgtrtttagcacgctgccctttgcctactgcaac

SEQ ID NO: 471 - DNA, 61 bp, Homo Sapiens
cccatataaggttagtgatcatttaaggtgytgatgaatcagtaaaattaaccccaaattt

SEQ ID NO: 472 - DNA, 61 bp, Homo Sapiens
atgactcagcccctcctcgccttctggaacrtacacagctacacagctgcagtacatagaa

SEQ ID NO: 473 - DNA, 61 bp, Homo Sapiens
agtctatggagagagaatcttgttcttgttsatgtcaaagataactatcatgttcaagtgt

SEQ ID NO: 474 - DNA, 61 bp, Homo Sapiens
agagatgcatagaggcatcttctattttccmtgagtaatgtctggcccttcccagtgggaa

SEQ ID NO: 475 - DNA, 61 bp, Homo Sapiens
ggttcaagtgatccacctgactcaaactcargtatctaggattataggcgtgtgccactgc

SEQ ID NO: 476 - DNA, 61 bp, Homo Sapiens
gaaagctctttcctgatttttccttcagttycagtcctttgtctccagaggaagtttaggg

SEQ ID NO: 477 - DNA, 61 bp, Homo Sapiens
tcagtttctagcctgaagagacgagggtctwacagagctgaaattgaagagagggccaagt

SEQ ID NO: 478 - DNA, 61 bp, Homo Sapiens
aagggagcactgccatcctttgtcatgattstctcatacctcttgggccatcaggaccagg

SEQ ID NO: 479 - DNA, 61 bp, Homo Sapiens
tggtcacgataggatcagaaaccaacagcartactttaaaaccaaagaaatgtttgtgtta

SEQ ID NO: 480 - DNA, 61 bp, Homo Sapiens
acacagaccttctttatctgccaaatctggrtatttattgcaatctatctgaaatgataaa

SEQ ID NO: 481 - DNA, 61 bp, Homo Sapiens
gactttttattttaccaggatttcgtatacrtatgagtcaatgagcaaaggcaggtggaag

SEQ ID NO: 482 - DNA, 61 bp, Homo Sapiens
aaatttaaaaattcaggtgaagggttgtaaygtagagttcaggaaatctcccagaaagtgt

SEQ ID NO: 483 - DNA, 61 bp, Homo Sapiens
tttggaatcaggacatcagagctgattctcrggctaataaattatccaggcaaatccgttt

SEQ ID NO: 484 - DNA, 61 bp, Homo Sapiens
cccatttctgctgtactcatctcagacttakaaaaataaatttccaaaccttctaataaaa

SEQ ID NO: 485 - DNA, 61 bp, Homo Sapiens
tgctttcttaggtttattctcttcccaattwtctgagtacagctctcacactaaaagccag

SEQ ID NO: 486 - DNA, 61 bp, Homo Sapiens
atgtgcactttatcctcattccataaatgtyggtgcataccttatgtaagggagcagttca

SEQ ID NO: 487 - DNA, 61 bp, Homo Sapiens
caaggttacttaattcaacttaactatcatsttattcagcaccaagcatgtcccaggcact

SEQ ID NO: 488 - DNA, 61 bp, Homo Sapiens
gccaaattttttttcaatgtactaccttctrtgaggcaatatgtaagtacagtgggtatca

SEQ ID NO: 489 - DNA, 61 bp, Homo Sapiens
gctgacctaagtgactttggaaatgggtagsattgataagactaaatgcaaaataagtggt

SEQ ID NO: 490 - DNA, 61 bp, Homo Sapiens
gttggggcttagtttgtgcctcacagagaaragatgctcacgaaacactggatgagagaat

SEQ ID NO: 491 - DNA, 61 bp, Homo Sapiens
ctatatattagctcttgggccttggataaayggcttaaatatctcttagaccttgatttcc

SEQ ID NO: 492 - DNA, 61 bp, Homo Sapiens
taaacagagcattctccctcccgtgttgttrctcacaccgttcccctttaccccaaatgcc

SEQ ID NO: 493 - DNA, 61 bp, Homo Sapiens
gctttcttgcctgcctcccactctagccagrtggagcaatggacttggcctccttgaacaa

SEQ ID NO: 494 - DNA, 61 bp, Homo Sapiens
ggagagcagagaatgagacaggatgggatgygaaactgcagaaggggcggcggctccccag

SEQ ID NO: 495 - DNA, 61 bp, Homo Sapiens
gggagacagaaagcaaggaaaggcccatagsttctaccaaggattaccaagtagagcttgg

SEQ ID NO: 496 - DNA, 61 bp, Homo Sapiens
cacacgtatttttgcaaagtggcgctaagartgcacacatttcagagtctgcttctccacc

SEQ ID NO: 497 - DNA, 61 bp, Homo Sapiens
cttttggtaagattaaacaaatggaagaaaytggcttcacatgaaaatgaaagtggaaacc

SEQ ID NO: 498 - DNA, 61 bp, Homo Sapiens
gcagtctaagcgccggtccaacctgttcacygtgagtgtcaaccctgggtggagatttgaa

SEQ ID NO: 499 - DNA, 61 bp, Homo Sapiens
gagttccttatcgtggaacactgttctttcscagtttattcaaatttgtattatagcctcc

SEQ ID NO: 500 - DNA, 61 bp, Homo Sapiens
cttaggatgtgaagcttagctgtgctttccwcggtcagcagggtctgtcatggggctgacc

SEQ ID NO: 501 - DNA, 61 bp, Homo Sapiens
accttgactggtattacattgcctccttcaygtcgactccatttcattatctgtggatgct

SEQ ID NO: 502 - DNA, 61 bp, Homo Sapiens
tttcctgatatgtcctatcacatatctctartccaaatactttctcattctcctgaagatc

SEQ ID NO: 503 - DNA, 61 bp, Homo Sapiens
acaagcacagttctaagtctattattaccaygtcctcttaactagactgttatctctaatt

SEQ ID NO: 504 - DNA, 61 bp, Homo Sapiens
gggagatgattgttttatcagctttactgaratttctcatttgctccttaacactctatta

SEQ ID NO: 505 - DNA, 61 bp, Homo Sapiens
cattctgtcctctacgcttctgagcattcakaccttttctcatccatttttgtattccact

SEQ ID NO: 506 - DNA, 61 bp, Homo Sapiens
tatgaaacgtaatggtagattgtgactgaayttagaacagtcttgtgtcgcgcagtgcctt

SEQ ID NO: 507 - DNA, 61 bp, Homo Sapiens
attaaagttgtcacttatgaaacgtaatggyagattgtgactgaacttagaacagtcttgt

SEQ ID NO: 508 - DNA, 61 bp, Homo Sapiens
gtagacaaaccttgatgattccacagatgayactttctccttggaccaggttgtcgagccc

SEQ ID NO: 509 - DNA, 61 bp, Homo Sapiens
cagagttgaggacaacttaccatcttccccmgagtagacaatggtcacagtactcagggat

SEQ ID NO: 510 - DNA, 61 bp, Homo Sapiens
cttcgcaatagctcctattcaacagtcctakcctactagcctgttgttagcatatgataat

SEQ ID NO: 511 - DNA, 61 bp, Homo Sapiens
ctttttctagaaatttctgaataactaactyacccattaatttgcatgtaattagaagtgg

SEQ ID NO: 512 - DNA, 61 bp, Homo Sapiens
aaatatattaattctaatcacagtaagcaartttattcaaatctggtcatttgggaatgcc

SEQ ID NO: 513 - DNA, 61 bp, Homo Sapiens
ggctcgacagcttgaacgtgattgagtgtcyatttaagcctacttgtattttcatctgatt

SEQ ID NO: 514 - DNA, 61 bp, Homo Sapiens
gttctgattttggtaggattcttaagtccayaattccctaatctgcccactttgctcagag

SEQ ID NO: 515 - DNA, 61 bp, Homo Sapiens
taagtttattaagaacaagatgttaaggaascaaaagattatcactgaactgagctgggag

SEQ ID NO: 516 - DNA, 61 bp, Homo Sapiens
ctttactcaaatatcaataaaactcacttgygggaaagtaccattggaggggaagaaaggg

SEQ ID NO: 517 - DNA, 61 bp, Homo Sapiens
aattattacttgaacaactattgaaagtccrgcaatgtgctagttgccatagggagataaa

SEQ ID NO: 518 - DNA, 61 bp, Homo Sapiens
gatacatgacacatacataatcatacatctrtgaactacccagtttacagtattttgttat

SEQ ID NO: 519 - DNA, 61 bp, Homo Sapiens
aagtcataactgtgagtatgaatatatgccragtcctgtgaatcctcctagtaaaacatca

SEQ ID NO: 520 - DNA, 61 bp, Homo Sapiens
tgagggtctagcagagtcttccaggaaaaasaatttgaacttgattttgaaaaacgaaaat

SEQ ID NO: 521 - DNA, 61 bp, Homo Sapiens
aggacttgacaatagaagagataagcaagcrcaattttgaagtcaagcctatttcagcttc

SEQ ID NO: 522 - DNA, 61 bp, Homo Sapiens
ggagggccgtgatgagaagctttgacactcytgaatgtgcctgaggatttatctgtgccta

SEQ ID NO: 523 - DNA, 61 bp, Homo Sapiens
tgagatgtggaagtaaaatctccaggccacraaaatacaagattggggcttatctcgcttc

SEQ ID NO: 524 - DNA, 61 bp, Homo Sapiens
actggaataaaaatgttttttgcttctttasgaatggcattatacagtacttcctcaaagc

SEQ ID NO: 525 - DNA, 61 bp, Homo Sapiens
ttttctttatttgcacttttcttgggaatakaatcaaatcttccctgcccccccttttttt

SEQ ID NO: 526 - DNA, 61 bp, Homo Sapiens
cggggctttgtggagaaggtggggctcttamcctgagtcctgaaagacaggcaggacttga

SEQ ID NO: 527 - DNA, 61 bp, Homo Sapiens
gctaggactttgagcctttgtgtctcagccraagtgtcatctcagcaaggtcttcccctcc

SEQ ID NO: 528 - DNA, 61 bp, Homo Sapiens
acagctttgtgtggtttgtcctgtaatatastacttatcactgcctctttattctttgata

SEQ ID NO: 529 - DNA, 61 bp, Homo Sapiens
acttgtattttaggaggagtattccaaaatmtgtgagtaggaaaagcaaaaaaatattaat

SEQ ID NO: 530 - DNA, 61 bp, Homo Sapiens
atatctacacattcatccatgtatctttctrtaactacacaaatatataataaaaagcatg

SEQ ID NO: 531 - DNA, 61 bp, Homo Sapiens
ctggccccggcctccccatctgtaaaatgcrgtagaccaggcgcggtggctcacacctgta

SEQ ID NO: 532 - DNA, 61 bp, Homo Sapiens
gcatctcacatattatttaaccttcaataamcctgtcagatgccaggcacagtggctcatg

SEQ ID NO: 533 - DNA, 61 bp, Homo Sapiens
cttcccacagaaggacttactcctcagtgawattccaagcagcaccgcctcgctctgctcc

SEQ ID NO: 534 - DNA, 61 bp, Homo Sapiens
ggggtcggggatctctttatagtggacgtcrccgacataggcctgtaccactgtcatgcga

SEQ ID NO: 535 - DNA, 61 bp, Homo Sapiens
ctttgacagagcatacctaattccatttctstgtgacagtactcttcaagtattggatcaa

SEQ ID NO: 536 - DNA, 61 bp, Homo Sapiens
tgaacgcacaacatgcacattcatcctcacrtgtggcacgtaaggtctcatttgatattgt

SEQ ID NO: 537 - DNA, 61 bp, Homo Sapiens
caacacccagtcctattccaaactctcaacrattctatcttgttcctgtttttctatgtat

SEQ ID NO: 538 - DNA, 61 bp, Homo Sapiens
tagatattagtgggttttttttccccttttyagtgaatacttgctaggcactgacaacaca

SEQ ID NO: 539 - DNA, 61 bp, Homo Sapiens
attttattaagatataatttacaaaccatgyatttcacccatttaaagtgcacaattcaag

SEQ ID NO: 540 - DNA, 61 bp, Homo Sapiens
tttatctttatattttatagatgaggaaatmacaatatagaatggttaagttactgcctga

SEQ ID NO: 541 - DNA, 61 bp, Homo Sapiens
tgcctgaggtcacaggggtgggtaagaagtkggcaaaaataggaattcaggtatttgggtt

SEQ ID NO: 542 - DNA, 61 bp, Homo Sapiens
actgcttaagtaatccttccaaaaggtacgycttgtctactcagtgactgctcactgccct

SEQ ID NO: 543 - DNA, 61 bp, Homo Sapiens
aaatactacacacttcatgtggtcctttctkctatttgccttacattcaagtatttagtta

SEQ ID NO: 544 - DNA, 61 bp, Homo Sapiens
aaaagttaaccaaacatatcaaaaagttaartgtgatgatatactgatattaggaggcatt

SEQ ID NO: 545 - DNA, 61 bp, Homo Sapiens
gaggccaaaagccacagtcagaggagatttkatgacagaacaggtcagatgaagagatgtg

SEQ ID NO: 546 - DNA, 61 bp, Homo Sapiens
tgcatattttttagttagaggatttagtgtkcaaatagctgcaaatgtatgtatttgatcc

SEQ ID NO: 547 - DNA, 61 bp, Homo Sapiens
tgcagtaacttgcaagttgaaggcatgaaartagggagaataaatgattttttcttaggtc

SEQ ID NO: 548 - DNA, 61 bp, Homo Sapiens
gcaggcttcctcccagtcagtgcaatatccrgcagtctcttttcctccccagcacctccta

SEQ ID NO: 549 - DNA, 61 bp, Homo Sapiens
ctggtactctcttgggtatcccttgcagaakattagaagtgattactgtcaagatataaaa

SEQ ID NO: 550 - DNA, 61 bp, Homo Sapiens
ttaagtttaaaaatttacattatctacattytcattctctgctttcttcctcctttcttcc

SEQ ID NO: 551 - DNA, 61 bp, Homo Sapiens
gaagataacaaagcatttgattgactctgtrtggaaaagtagtaggtacaagaaggtgaag

SEQ ID NO: 552 - DNA, 61 bp, Homo Sapiens
atacttctctatttctgtgtaacactgattycttagatctggatttgaaatcagaagcatt

SEQ ID NO: 553 - DNA, 61 bp, Homo Sapiens
tcatagttacctgcttgtttttacttgtatktatgagatctgaaggccacagaattaaaat

SEQ ID NO: 554 - DNA, 61 bp, Homo Sapiens
aatttaaactctctgaagtaaagttatcatmgttacctgcttgtttttacttgtatttatg

SEQ ID NO: 555 - DNA, 61 bp, Homo Sapiens
ccactgcctacatgttgtgttatcttgtatraatggcttgcactgctctgccggccatctc

SEQ ID NO: 556 - DNA, 61 bp, Homo Sapiens
atatcatacatcctgaatttgagacctccastgtcgtaagaaagtgccaccaaatcctcac

SEQ ID NO: 557 - DNA, 61 bp, Homo Sapiens
aggggtgactggttagtcagagggtcagagycaagtcataggctgagaagccatgtttacc

SEQ ID NO: 558 - DNA, 61 bp, Homo Sapiens
gcatcatgaatcaacagcaaattcaggtctyagatccaggtcttatgatttaaggtcctat

SEQ ID NO: 559 - DNA, 61 bp, Homo Sapiens
ctccatttccaatttatgcatataacatttktatccattcttcaaagaaagtctcagagtt

SEQ ID NO: 560 - DNA, 61 bp, Homo Sapiens
ccagacttagaaaaaggagcgcccagatacmtttgaacttcagataaaaaaatcattttta

SEQ ID NO: 561 - DNA, 61 bp, Homo Sapiens
catagataaatttatgtggaaaggcaatggrattagaatagctaaaattatgacaggtcag

SEQ ID NO: 562 - DNA, 61 bp, Homo Sapiens
gtgctgaccgaatcaggttccaggagccctyctactccagatgtggtacaaaaataggcct

SEQ ID NO: 563 - DNA, 61 bp, Homo Sapiens
aaaaagaaattcatattggatacactatacyaaaactgcagaaagccaaaatcagagaaaa

SEQ ID NO: 564 - DNA, 61 bp, Homo Sapiens
cctctgctgactgtgcatgttttccctccaygccaattagcacttgctgtgtgcagggcct

SEQ ID NO: 565 - DNA, 61 bp, Homo Sapiens
aggaaaggcagagaatggcagagtccacttktactaaaatcaaagcaggagagacccaggt

SEQ ID NO: 566 - DNA, 61 bp, Homo Sapiens
catgtggtttttctggcatatggaaatcccrcatgggtgcctctacacggaatggccacaa

SEQ ID NO: 567 - DNA, 61 bp, Homo Sapiens
cctctgagatggggaggatggcgcccagctsttctggccacagaggagatgcttggcccat

SEQ ID NO: 568 - DNA, 61 bp, Homo Sapiens
tttcccagcatctcttgcaggtcactgtatyaaagcctctgacaagtcctgaagtccaaag

SEQ ID NO: 569 - DNA, 61 bp, Homo Sapiens
agaggggtctgtggagtagagccagaagccsgtgtccaacattcagcaattactccaggcg

SEQ ID NO: 570 - DNA, 61 bp, Homo Sapiens
cataggggcacaaggctggtgctacttaatscatttttcagaaggaggaagctcaaaacaa

SEQ ID NO: 571 - DNA, 61 bp, Homo Sapiens
gagatcagaagagatagtgcacgttcagagyggtacagccatagatgtgcagggaggcgtc

SEQ ID NO: 572 - DNA, 61 bp, Homo Sapiens
ccaggcctgtgccaggaggcaggaagcttcragcagctggatactttggccctcagagatg

SEQ ID NO: 573 - DNA, 61 bp, Homo Sapiens
tcaggggttgtaggagatcagtgatgtcatstatgtaaaccacctgccccagagcagccag

SEQ ID NO: 574 - DNA, 61 bp, Homo Sapiens
aaaactccagcagcaacaggggccagcattyaccttcccgcatccgtgcacagtgtttgcc

SEQ ID NO: 575 - DNA, 61 bp, Homo Sapiens
caggtcacagaggtcacaaacacccgtcagrccgcacatacctcaactcagaacatcagtc

SEQ ID NO: 576 - DNA, 61 bp, Homo Sapiens
cccatcatcaagcttcctacagagcttagcytggagcctggccaaaaagagttctggaaac

SEQ ID NO: 577 - DNA, 61 bp, Homo Sapiens
caacttgcccgagaccacactgctgaaccasaatctgaacccagtcaactcagccatggcc

SEQ ID NO: 578 - DNA, 61 bp, Homo Sapiens
cctgcagaggggatttgctttgctaaaggaktcaccacagagcacccgagagtaacaggtt

SEQ ID NO: 579 - DNA, 61 bp, Homo Sapiens
agcatgaagtagtacctagttaagcaaatayaaggagcatctgctcaggagggaggatgca

SEQ ID NO: 580 - DNA, 61 bp, Homo Sapiens
gacaaaaggaggagggatgacccagtaggartcagtcgcagaagtatagggataaaatgat

SEQ ID NO: 581 - DNA, 61 bp, Homo Sapiens
ccatgaaagtaacgttaaacagctccaatcrcacaggaagccattggcacattagaatctg

SEQ ID NO: 582 - DNA, 61 bp, Homo Sapiens
catattcagatactgtcaatattcaaatccycacagctgcatataaggccacaaatcatca

SEQ ID NO: 583 - DNA, 61 bp, Homo Sapiens
cccaataaagttcctgcagttgagaatccaycctttctcagaatcactttctgaggatcac

SEQ ID NO: 584 - DNA, 61 bp, Homo Sapiens
gctctggcacatgttttaggtgtagagacarcattgggcagtgggaaaaggataagtcaat

SEQ ID NO: 585 - DNA, 61 bp, Homo Sapiens
gtgtaaaacacaaacagtgaggcaataatgrtaaagaagagataggataacgcatgagctg

SEQ ID NO: 586 - DNA, 61 bp, Homo Sapiens
gagtgcttactgtgtgccaggtcctgtaacrggcatcagtgataaaatggtgaacaaaact

SEQ ID NO: 587 - DNA, 61 bp, Homo Sapiens
aatcacttatattaatttataatacaccttsgtttcagaaagaaatggctgtgtttttaat

SEQ ID NO: 588 - DNA, 61 bp, Homo Sapiens
cgtgtatctttgttggaatggacattaggtytccaagtccaggcctgtgatttagaagggt

SEQ ID NO: 589 - DNA, 61 bp, Homo Sapiens
ggcatggctggtcctaggtggtacagaaatrttgcacttttttaacaactgaagcagctat

SEQ ID NO: 590 - DNA, 61 bp, Homo Sapiens
ttttgaagtatttagtggatattttattgastgaagattacacttagttttcatgttggta

SEQ ID NO: 591 - DNA, 61 bp, Homo Sapiens
ctttggaaaacaatgttcatggaaagcaatraacattctcgtcaatcactatattcttcta

SEQ ID NO: 592 - DNA, 61 bp, Homo Sapiens
catatagtatataaagctaccataattctgytttaggggaggatggagaagaaaagattag

SEQ ID NO: 593 - DNA, 61 bp, Homo Sapiens
cctcaagaatgtgagaaaaaaatgttggtcrtttataagccacccagtttgtggtattacc

SEQ ID NO: 594 - DNA, 61 bp, Homo Sapiens
cttaactctaaacttaacccttgaatcccawctcctagctttcacctctcaagtgtcttaa

SEQ ID NO: 595 - DNA, 61 bp, Homo Sapiens
tgagtgagagagacattttgcaaacatgggyagaatgtggctttgtgacttgcctcaagat

SEQ ID NO: 596 - DNA, 61 bp, Homo Sapiens
actcgtgatcatctgtgcatacaccagaggmtaaaaatgttcggacagagagggccagtat

SEQ ID NO: 597 - DNA, 61 bp, Homo Sapiens
caagcaacaagcaaagttccattatcatcaycattctcttccccacacaaaagaggcatag

SEQ ID NO: 598 - DNA, 61 bp, Homo Sapiens
actcctacctataaacttctaaaaacactgytcacaagtacatcattcccctatggcttcc

SEQ ID NO: 599 - DNA, 61 bp, Homo Sapiens
aaagcaggaaatggacatgatcaggttgagwgtataagccgtctccctagctcagtggaga

SEQ ID NO: 600 - DNA, 61 bp, Homo Sapiens
gaatgtctgtttcaggatttaacttgtccartgcaaagaagtgaggctgggccacaagtga

SEQ ID NO: 601 - DNA, 61 bp, Homo Sapiens
tttcacttcatgtgttttgtagattgttccwtaactatacacagaacctccacatcctatc

SEQ ID NO: 602 - DNA, 61 bp, Homo Sapiens
tatcagatatatttacaggtcaaaaggcaarattgaaacaaatttagtttaaagatcttaa

SEQ ID NO: 603 - DNA, 61 bp, Homo Sapiens
cagcctcttccttggcccccacaaacataaygcagaaggcttccaaaagaccagtgctagc

SEQ ID NO: 604 - DNA, 61 bp, Homo Sapiens
gaaacatttattgaataataacaagagatcracactagaaaagacagcaatttgctagcag

SEQ ID NO: 605 - DNA, 61 bp, Homo Sapiens
acgtaaccaattcctaattttaaaaatcctrgacatcaagtcttgagtgagcttccctggt

SEQ ID NO: 606 - DNA, 61 bp, Homo Sapiens
gcacatatcaacttagcaataacaagagctracacttgtattgcacttacacattccagat

SEQ ID NO: 607 - DNA, 61 bp, Homo Sapiens
ggaaagagctgaaattataatccatttggcraaataaagggaccatgtttaggacacaaat

SEQ ID NO: 608 - DNA, 61 bp, Homo Sapiens
ttgtaaattacataaacctatgatttgggtrttaaacataacattgcttacataaatctaa

SEQ ID NO: 609 - DNA, 61 bp, Homo Sapiens
atgtcttgggggttacctgatcactgaggargagtacttggagttggtatgtgaaacatca

SEQ ID NO: 610 - DNA, 61 bp, Homo Sapiens
atctagctctgtcactcaaggtttggcaaawccgcacggggcagaaggatggtccatacct

SEQ ID NO: 611 - DNA, 61 bp, Homo Sapiens
aatgaatattgtgcagagaagtaaaataagwattagtgggagtggagaggatcaaataata

SEQ ID NO: 612 - DNA, 61 bp, Homo Sapiens
ccttggacggctgcagccacctccttactgrccttcttgacttcaccccttaagtgaattt

SEQ ID NO: 613 - DNA, 61 bp, Homo Sapiens
ttatttggtcattttctgttattgcttactrtcatttcattattcatgtaataactggctt

SEQ ID NO: 614 - DNA, 61 bp, Homo Sapiens
gtagactttgctgattcagagaagtggtagrgctaaatatgttgaagatgccaggggcccc

SEQ ID NO: 615 - DNA, 61 bp, Homo Sapiens
tgggtgtttcactttgccttactggtccttmctcattccagttctgtaggaagagtagact

SEQ ID NO: 616 - DNA, 61 bp, Homo Sapiens
cggcagtctatgtctacatattcatggcacrctggagccctcccctgactgtgctcataca

SEQ ID NO: 617 - DNA, 61 bp, Homo Sapiens
acatagtctcaggccaaaaaacaagcaacayccgaaaatgaaagttgaagagagaagagaa

SEQ ID NO: 618 - DNA, 61 bp, Homo Sapiens
cccatgattttttaatttggcacaaaactcyttgcctggactattaccttacttcgcgaaa

SEQ ID NO: 619 - DNA, 61 bp, Homo Sapiens
acaacgcggcctttgatcatggggccagggwcacactcaaaaggatgagtgacagaaagca

SEQ ID NO: 620 - DNA, 61 bp, Homo Sapiens
ttcattattatgttaggctgtggtcactaawctgtaatgcatctttaagaatgaggatata

SEQ ID NO: 621 - DNA, 61 bp, Homo Sapiens
actcagctcatcaatgcaccagactcggccraaaatttctcaacttgttgatacaaagcta

SEQ ID NO: 622 - DNA, 61 bp, Homo Sapiens
ctcatttcaaatctctctgctttaaaatctrtacataccgataatgagttccaagacaaac

SEQ ID NO: 623 - DNA, 61 bp, Homo Sapiens
agataggctagaaatagaattgccaggtcartatgtgtgaagcatgtttaaacattctaat

SEQ ID NO: 624 - DNA, 61 bp, Homo Sapiens
aggaaactgcgtttgtgtgacctcttggaarcctcctcctggtagctgggcttcctgggat

SEQ ID NO: 625 - DNA, 61 bp, Homo Sapiens
tttttgtttccatgtgtgcacaatatttacyttccacgtataagaaaatgtggcacatata

SEQ ID NO: 626 - DNA, 61 bp, Homo Sapiens
ttaacgtaagtctactctgagaattagatcygctcttggagtgctaacaaaccagttttcc

SEQ ID NO: 627 - DNA, 61 bp, Homo Sapiens
ttaaatactaacggaaatgaaaccaggaaaygttatcaggatcaaaaattacttttacatg

SEQ ID NO: 628 - DNA, 61 bp, Homo Sapiens
ggctcagccataagtgacacactgttccccragtaaacatctgcgcttcttcactgctcag

SEQ ID NO: 629 - DNA, 61 bp, Homo Sapiens
tattggggtcattttattccttcaggttttytaaaggtcacagggattagctgtgtccaat

SEQ ID NO: 630 - DNA, 61 bp, Homo Sapiens
aagcaaaatcaaatgatttaggcatgatagragaaatagacaaagccaatttttgagttga

SEQ ID NO: 631 - DNA, 61 bp, Homo Sapiens
acctcaaggctcaatcctcagtcagacccaygcttttcttttcaactctcccactgagaaa

SEQ ID NO: 632 - DNA, 61 bp, Homo Sapiens
aattattaaatgtccaacataatttctctgraggtacagaagcaaaatatagtgatcagat

SEQ ID NO: 633 - DNA, 61 bp, Homo Sapiens
accaaagcaatgtggatatcactaccttccrcacaacaggtgactggcttaatggtgtctg

SEQ ID NO: 634 - DNA, 61 bp, Homo Sapiens
taatatcttacttttggaccattttcagtaygatgtctttaatacctttaaataatagctc

SEQ ID NO: 635 - DNA, 61 bp, Homo Sapiens
aaaaactacatataattccctcttctgagtygccttgaaacaagggtgataatttgtcata

SEQ ID NO: 636 - DNA, 61 bp, Homo Sapiens
ggctttgaacaaaagaattatttcatttgtkttttacaatggtcacaagtgccgtagcgag

SEQ ID NO: 637 - DNA, 61 bp, Homo Sapiens
attttaattaattttacatggaattttcgayatcagttctttcacttataagagaagctac

SEQ ID NO: 638 - DNA, 61 bp, Homo Sapiens
aattcttatactactatattttattccctcractgccaggttcattaaaaaccctttacat

SEQ ID NO: 639 - DNA, 61 bp, Homo Sapiens
aagacgtcattacatatagtatgtgttgaaytaatgcataaatgaatacacttctgtacat

SEQ ID NO: 640 - DNA, 61 bp, Homo Sapiens
gtagatgttggcatggatgtggtgaacagaraacgcttctaccctgctagtgggaatgtaa

SEQ ID NO: 641 - DNA, 61 bp, Homo Sapiens
cgcctgtggagttgtcactgaaatgatgcaygggccacttttaacattagtcatttgcctt

SEQ ID NO: 642 - DNA, 61 bp, Homo Sapiens
acatgtttctgaagctgaggagttggtttcyaacacgtgatctgacctgacctccactaga

SEQ ID NO: 643 - DNA, 61 bp, Homo Sapiens
tgccacttatcaactgtgacatcatgggcarttttcttgacttctgtggacccgtttgctt

SEQ ID NO: 644 - DNA, 61 bp, Homo Sapiens
aaaaggtggaaactatcaaccttcctcattyggtctgcagttagggtttccctgggactct

SEQ ID NO: 645 - DNA, 61 bp, Homo Sapiens
acttccttgaagagtcattttagcaaagacmcttcttctactcttacacactcctttgggc

SEQ ID NO: 646 - DNA, 61 bp, Homo Sapiens
acctgggaagagcatatgttttgtgtggaartgatgccaaaaaagcctcctgtgtggcaag

SEQ ID NO: 647 - DNA, 61 bp, Homo Sapiens
catgatttaatcggtactgtcaaattgttcmttgtaaagatcgtagcatttccacttctgt

SEQ ID NO: 648 - DNA, 61 bp, Homo Sapiens
acagtaggtgacatacatctgaaatttgtcwgcctaaaaagaacaaagataataatagata

SEQ ID NO: 649 - DNA, 61 bp, Homo Sapiens
aaaaacttgcataatctcatttcactgaacytgaaaaccagtctaattttaaatctgccat

SEQ ID NO: 650 - DNA, 61 bp, Homo Sapiens
tacccactaacgatgggccattgacatcatytctagctctgattagcatttctcagtgaag

SEQ ID NO: 651 - DNA, 61 bp, Homo Sapiens
gagttgataaaagggtattctgaacagaaamgtaaaaccaagagcacagaaacacctgctg

SEQ ID NO: 652 - DNA, 61 bp, Homo Sapiens
tcaaaacttcctaaaaattcccttgactctyttgaggactcagctccctgtgaagagatca

SEQ ID NO: 653 - DNA, 61 bp, Homo Sapiens
tgcagttaccttagacacttttcaataataytttggaccttgaaggaaaaactacatctct

SEQ ID NO: 654 - DNA, 61 bp, Homo Sapiens
ttctctcagctccaagtaattcagcacaagwatatcacttccttcttatcaatgtacctca

SEQ ID NO: 655 - DNA, 61 bp, Homo Sapiens
ctctgtccaacagtcaccctgttttgggctwggtcagagaactggacttcagtctttgtcc

SEQ ID NO: 656 - DNA, 61 bp, Homo Sapiens
attaattatttctttttaatcttcataacasttagtgagtggaatgctggagctggcttgc

SEQ ID NO: 657 - DNA, 61 bp, Homo Sapiens
tgctgcgtgactgtaaggtcttcctgcccayaggttgctcctggctattagtactactaat

SEQ ID NO: 658 - DNA, 61 bp, Homo Sapiens
ttcagggctgacaagtgagggctccttggtmattgcctatggccacactggaccctgaact

SEQ ID NO: 659 - DNA, 61 bp, Homo Sapiens
aactgggagacagagttgtgagtttggggaygttagtctttggcattgcagaaagtagagt

SEQ ID NO: 660 - DNA, 61 bp, Homo Sapiens
ctggggtccaggaggaccctggattaactgmagtttagatgccttggtggcagaggcccag

SEQ ID NO: 661 - DNA, 61 bp, Homo Sapiens
gaggggtctttataggcatggttcccttaaytgagctctctagggcaggggtcaaagaaga

SEQ ID NO: 662 - DNA, 61 bp, Homo Sapiens
agattggcttttagagcaggtactgtggaartgaggaagaaagtccctgccatcacatggg

SEQ ID NO: 663 - DNA, 61 bp, Homo Sapiens
caaagtagacaccattgctgcagatgagagyttctcccaggtggactttgggggaaggctg

SEQ ID NO: 664 - DNA, 61 bp, Homo Sapiens
tattggaatgggagtgggactgtatcatgtrttgtattaacttttgcttctaaatgacaca

SEQ ID NO: 665 - DNA, 61 bp, Homo Sapiens
ccccagacacctgcagctgaagtgccaagcrggcttgttagtgccatcagctctgcaatcc

SEQ ID NO: 666 - DNA, 61 bp, Homo Sapiens
tgggatggttttaaaactgttgacgttgatkcatcagtggatctaagatctggcactctct

SEQ ID NO: 667 - DNA, 61 bp, Homo Sapiens
gcaggtgagacacagtgagccttcaacaackaactctctcccaacacagccctgagaattg

SEQ ID NO: 668 - DNA, 61 bp, Homo Sapiens
accaccaagcagtgacaagtgaaaacagcaragaggaataagccactgttcctcaactgat

SEQ ID NO: 669 - DNA, 61 bp, Homo Sapiens
tattttctcttcttttcctccatttattccrttctcttgtctgtcttctctctagacttgt

SEQ ID NO: 670 - DNA, 61 bp, Homo Sapiens
cagtagcttttaaaaattttaaactgtcttygtaggatgccttccttcttcagtctcatta

SEQ ID NO: 671 - DNA, 61 bp, Homo Sapiens
acagtggttccagaaaatgcttttccttctyacattgccttttattcaagtttattcaact

SEQ ID NO: 672 - DNA, 61 bp, Homo Sapiens
cacagtagtgcttaataaatgtttgttgaayatatgaatgtagtcatggggtcgtggttcc

SEQ ID NO: 673 - DNA, 61 bp, Homo Sapiens
ttaatcctcgcattaatcatgtaatgtagtstttcagccagggctctccagtgtaaatacc

SEQ ID NO: 674 - DNA, 61 bp, Homo Sapiens
gagaacacctttaaggcaaggggcctgttaygtcataccatcatcacaacagcccatagat

SEQ ID NO: 675 - DNA, 61 bp, Homo Sapiens
tgctgtctatttcaaggggaactggaagtcrcagtttaggcctgaaaatactagaaccttt

SEQ ID NO: 676 - DNA, 61 bp, Homo Sapiens
tcaagtgatcctcctccctcagtctctcaamtatctgggatcataggcacatgccaccaca

SEQ ID NO: 677 - DNA, 61 bp, Homo Sapiens
atgaaggggactaaataggctcagccactayctacttgagtgagctcagccatggcagctc

SEQ ID NO: 678 - DNA, 61 bp, Homo Sapiens
ggattgagaatttctttgaccgataagtccrgtatataatgtgtcggtgagaattaactta

SEQ ID NO: 679 - DNA, 61 bp, Homo Sapiens
cattttgatttggtagtatagcaatcaggamagcaattaaccagaacaaaagactacatgg

SEQ ID NO: 680 - DNA, 61 bp, Homo Sapiens
tggattgaataggatctctgcataatgagaygagcttggcagtttaacaattaatggttgt

SEQ ID NO: 681 - DNA, 61 bp, Homo Sapiens
ctgacctttctcccactagtttttcacactrtcaaatcataaaagcccaggaatcatgtgg

SEQ ID NO: 682 - DNA, 61 bp, Homo Sapiens
aaagaaaatgcaaatgaaaaccccagtaaamtactacctcacgcactctaggaagtctata

SEQ ID NO: 683 - DNA, 61 bp, Homo Sapiens
catgccacaacatggatgaatcttgaaacaktatgctagtcataaaatatcacatattata

SEQ ID NO: 684 - DNA, 61 bp, Homo Sapiens
cagtgctgccactcttctgtcttctttatcycagaggaactcctctgcactcctccagtca

SEQ ID NO: 685 - DNA, 61 bp, Homo Sapiens
tttcaaccagtggctctcaaacattgacgcrtattaatgtcacatggagacatttttaaaa

SEQ ID NO: 686 - DNA, 61 bp, Homo Sapiens
tcagcacatcccctggcacttggtatgcagytattgatttagcgaatacattcttttcaat

SEQ ID NO: 687 - DNA, 61 bp, Homo Sapiens
aaccagaagcatggcctgtaatgactgttcragtaatatcattatctttcatttctccaaa

SEQ ID NO: 688 - DNA, 61 bp, Homo Sapiens
ggctgttaatggcctgtcatgtgcttttttyggcagagcagtgaggaactctttgagagcc

SEQ ID NO: 689 - DNA, 61 bp, Homo Sapiens
aggaaggtacatctcctgggaagtagagctwtcacacaataatcaattcatgcaaaaagca

SEQ ID NO: 690 - DNA, 61 bp, Homo Sapiens
ttcctgattttagcctccaccataaggtccytgcatctatatgtagagaacacattgcagt

SEQ ID NO: 691 - DNA, 61 bp, Homo Sapiens
tccttcctgttgcttagtggtgtcaagatayagtgtcaatgttaccagaagtgcctaacac

SEQ ID NO: 692 - DNA, 61 bp, Homo Sapiens
atagatctgcttccatttaaaaaatcatggytagtggcaagaaattacactaatgttaccc

SEQ ID NO: 693 - DNA, 61 bp, Homo Sapiens
caacttgctgtggacatagataagctcagtkactaggtttccttcgagctctgcatgtgtt

SEQ ID NO: 694 - DNA, 61 bp, Homo Sapiens
ttttagaatagaataaaagcatttacatgayctaaatcaaaaggtctcctgccacgatctg

SEQ ID NO: 695 - DNA, 61 bp, Homo Sapiens
tcaggatgtgatttccagctgaggaccttcyttatggactacatccaaggaccagttgccc

SEQ ID NO: 696 - DNA, 61 bp, Homo Sapiens
acttgcaatgacttcctatcacctaccccarttaaattacttccaggcctaacccaaatgt

SEQ ID NO: 697 - DNA, 61 bp, Homo Sapiens
agttctgccacttcacaaattacttaccagmatgaggtctagtgagtccttgctcagactc

SEQ ID NO: 698 - DNA, 61 bp, Homo Sapiens
tgttaattcattatgtcttgatgtacctcartgactgggttatatttattgataggtttta

SEQ ID NO: 699 - DNA, 61 bp, Homo Sapiens
aaaacttgacaggtgaaaatgacttggaaaygatagatacataaaaacaaacaaacaaaaa

SEQ ID NO: 700 - DNA, 61 bp, Homo Sapiens
ttattttttaaaattacatttttacagatckacacttcctagaactaagagaatgacacag

SEQ ID NO: 701 - DNA, 61 bp, Homo Sapiens
accaatgaattgtatactttaaagggcttawcttgatgatctgtaaattatacaatatcaa

SEQ ID NO: 702 - DNA, 61 bp, Homo Sapiens
atatgtgttccttgaatatgtcgatgttgcratttgtaaaatagcacagtggttaagctgg

SEQ ID NO: 703 - DNA, 61 bp, Homo Sapiens
tttgcttcttgtgtccccagtacaagtatarttcctaaaacatggtagattaattttaaat

SEQ ID NO: 704 - DNA, 61 bp, Homo Sapiens
gatctttattcctatagtgcataatagttcrtttttggcccatctactttgataccataga

SEQ ID NO: 705 - DNA, 61 bp, Homo Sapiens
gttaaaagatataccagaattactagaaggwtgatacagcaaactagaagctgtgatattt

SEQ ID NO: 706 - DNA, 61 bp, Homo Sapiens
gtgcgtgctctgcctgttgatggcaatgtcyctgtttccaatgtccttcctcatcaactgc

SEQ ID NO: 707 - DNA, 61 bp, Homo Sapiens
caagagacataaagaattacagatttccagstcaaccccctcctttttcagatgggaaaaa

SEQ ID NO: 708 - DNA, 61 bp, Homo Sapiens
ctcaagaaattcacagtaaaaattcaacatkaaagttttggtaacatcacaaaaagaagga

SEQ ID NO: 709 - DNA, 61 bp, Homo Sapiens
acaaaaagaaggaggaagagaaggatgagaragaggaaaaggataggaaggagaggagaag

SEQ ID NO: 710 - DNA, 61 bp, Homo Sapiens
gtggtgtctttcttcttttgaatttgagcarctcttttataataagaattttctgaatgtt

SEQ ID NO: 711 - DNA, 61 bp, Homo Sapiens
tgtttaaataaggcaagtttgtgtccagaarggtttgcatttagcagcatctctgtacaat

SEQ ID NO: 712 - DNA, 61 bp, Homo Sapiens
gcatggcaaagccagtagatagtagtaaatyattgcatgaagttcatcagaataaaatcaa

SEQ ID NO: 713 - DNA, 61 bp, Homo Sapiens
catgatgctgagactcatctacgcattttaytctagagttaggaagaacttccaattgtcc

SEQ ID NO: 714 - DNA, 61 bp, Homo Sapiens
tcagggcaggtgttgctaatgttttacatcmtgagtctcaaaggggctacatatttactac

SEQ ID NO: 715 - DNA, 61 bp, Homo Sapiens
tttttcatgaattgactcttaaattgtgaawtgtccgttttttctctgttaatactctgtg

SEQ ID NO: 716 - DNA, 61 bp, Homo Sapiens
attcactagactgatatgccactcaatcggrcagtcatttagcttattcaccacctctact

SEQ ID NO: 717 - DNA, 61 bp, Homo Sapiens
attttccaatacaggcataccttatggataytagcaattcagttccagaccaccgcaatga

SEQ ID NO: 718 - DNA, 61 bp, Homo Sapiens
ggcagtggaaatttggtggcccagaaggacrgacgagaggtacagagtaggagaggggtac

SEQ ID NO: 719 - DNA, 61 bp, Homo Sapiens
acctgtgggtcactcactggccttgaagggytagctgggcttgaagctctggtccctggtg

SEQ ID NO: 720 - DNA, 61 bp, Homo Sapiens
acctagccattagcccaatgaatgataccayctttctggcctggtcttctttgaactctga

SEQ ID NO: 721 - DNA, 61 bp, Homo Sapiens
cactggccacatgggaagtcacccggtacawtagccactacttccgtttcctggtatctct

SEQ ID NO: 722 - DNA, 61 bp, Homo Sapiens
gctccaggcaggagcctttgaaatgctcatygtgggacgcttcatcatgggcatagatgga

SEQ ID NO: 723 - DNA, 61 bp, Homo Sapiens
tgtgagtggctggaaccttgaaggacctcakacaatggcatctctcactacatcatgcagt

SEQ ID NO: 724 - DNA, 61 bp, Homo Sapiens
tgaggaatgaggctcacaaggtcaagtgagmtgattggagagggcctgggtaggaaaggct

SEQ ID NO: 725 - DNA, 61 bp, Homo Sapiens
aaacctcagaatgggtccttatttgaaatgyggtcattgcagatataattaattaagaaga

SEQ ID NO: 726 - DNA, 61 bp, Homo Sapiens
ggcactgaagttgatttggtttcagattttktcagtgtctggatgaattattttcttgaat

SEQ ID NO: 727 - DNA, 61 bp, Homo Sapiens
gtaaagtgagttttaggattttaacttgggrtaagactctttgaaagccatgacaaatgtc

SEQ ID NO: 728 - DNA, 61 bp, Homo Sapiens
atgctcatttgtgaatttttgaagatctctyttacggcattaatgctttcactagaacatg

SEQ ID NO: 729 - DNA, 61 bp, Homo Sapiens
cactcttatgtgctaggaagcgtttgttctrtcaagtagccagggtcaacctcaaggaact

SEQ ID NO: 730 - DNA, 61 bp, Homo Sapiens
ctgtatcagaaaggcccagctacttacacartcgctgaaactaaaatgggacaggaccaga

SEQ ID NO: 731 - DNA, 61 bp, Homo Sapiens
ctgcctcttgggaaggagtgggaagacacgrggtgagtaacctggagaaaatgaagggcca

SEQ ID NO: 732 - DNA, 61 bp, Homo Sapiens
cctaccttccttcttgtcttcattcattcaytggttagtttgttttttcatctaccagtgc

SEQ ID NO: 733 - DNA, 61 bp, Homo Sapiens
tttgtcactggcagaggaaactgggcatggrgcttatatcccgtgagtgactcctctggcc

SEQ ID NO: 734 - DNA, 61 bp, Homo Sapiens
acaatgctatgagataggctgtgttattagmactattgtgtagatgagaaaatgagaacaa

SEQ ID NO: 735 - DNA, 61 bp, Homo Sapiens
ctgagtatatctttcaactctaagagatgamgtatggaaggtaaatattatttttaataca

SEQ ID NO: 736 - DNA, 61 bp, Homo Sapiens
atcactcatatattatctatcatatctccayagcattagaattcctagatagccaagtatg

SEQ ID NO: 737 - DNA, 61 bp, Homo Sapiens
cacccctactcccattgaattcaagcacgargaatagaatcaccttcatgtatttgaatat

SEQ ID NO: 738 - DNA, 61 bp, Homo Sapiens
ttaactcccataatcacagttatacttgagkttgacattgtccatctgctacactaggtat

SEQ ID NO: 739 - DNA, 61 bp, Homo Sapiens
aaaagcacactataaacttatgtttgttccrgttctcacaagaaaaaaaaacgtagatgta

SEQ ID NO: 740 - DNA, 61 bp, Homo Sapiens
ttggtcccaggctaaggctgccaacagctcrtacaggttgagtatcccttacccaaaatgc

SEQ ID NO: 741 - DNA, 61 bp, Homo Sapiens
cagggagcactcttcagagcctttggtcccrtctgccaggagcactcttccttcttttttt

SEQ ID NO: 742 - DNA, 61 bp, Homo Sapiens
cttatccatgaagaagacaactacatcgagmtgattccccgagacaggaagatgtgcagcc

SEQ ID NO: 743 - DNA, 61 bp, Homo Sapiens
ttccactaacacctccatctttgatatctgsgtataggggtgatcaggaatactgttggct

SEQ ID NO: 744 - DNA, 61 bp, Homo Sapiens
tttgtattaaacgtttcctggcaacttgcartagcttaagccggtaatcccagcgttttgg

SEQ ID NO: 745 - DNA, 61 bp, Homo Sapiens
tagtgccactgcactccagccttggcgatayggccagaccttgtctcaaaaaaataaataa

SEQ ID NO: 746 - DNA, 61 bp, Homo Sapiens
ctgaatgaaagtaggagaaccagtggcatasagaataactgtagtatattggacagagatc

SEQ ID NO: 747 - DNA, 61 bp, Homo Sapiens
gttttgctgtttatagcaatggcttatgctrtcatgaggggaacaggaattagcagtcttt

SEQ ID NO: 748 - DNA, 61 bp, Homo Sapiens
aaatctgcttggagaagatggtaataatgcyggccattgatgaagtgtatattgtacaccg

SEQ ID NO: 749 - DNA, 61 bp, Homo Sapiens
cttttctagtttccaaagtccataatttccrgacagcaggaatagttatgcaaagaacaga

SEQ ID NO: 750 - DNA, 61 bp, Homo Sapiens
agactgtaaaagatattggaaatggatcaargcactctgaacatattcaaataattgctgt

SEQ ID NO: 751 - DNA, 61 bp, Homo Sapiens
aagatggccgtgaattaggatgtatgacagygagacacgtatgtgcaccattctggtcttc

SEQ ID NO: 752 - DNA, 61 bp, Homo Sapiens
aaaaggttaaatttatggttaaaaaataagygcattcatgaaaagagcagccagcttggct

SEQ ID NO: 753 - DNA, 61 bp, Homo Sapiens
tgcctacccccattgcaggactggtgagtaygtggaattgagatttattttccaatattcc

SEQ ID NO: 754 - DNA, 61 bp, Homo Sapiens
ttcattctcaaagagctaaatttgttttggkgtgagaggctgataattaggttgacccttg

SEQ ID NO: 755 - DNA, 61 bp, Homo Sapiens
gtctaacgtcatctggagaactgtttaagcrgaatccttgcccttctgaacctatccacat

SEQ ID NO: 756 - DNA, 61 bp, Homo Sapiens
cgccatcccgcaaccccctgttatgttcatrtacttccacggttctcgcgtcatgcctgtg

SEQ ID NO: 757 - DNA, 61 bp, Homo Sapiens
tggccacccctctccttggttattacatatmcactgttcccagttgaagatgggacacatt

SEQ ID NO: 758 - DNA, 61 bp, Homo Sapiens
ttagccaaatttatgaggctgggttgaaaaycaggttgaaacagagcctggcgaatcccta

SEQ ID NO: 759 - DNA, 61 bp, Homo Sapiens
tctgagaaactccagatgcttctcttttacygctcaacattttctgctccctttgtgattt

SEQ ID NO: 760 - DNA, 61 bp, Homo Sapiens
tcagtgagtcatgagttcttcctttttcagytagtcaggcctggcttttgttcaagtcctg

SEQ ID NO: 761 - DNA, 61 bp, Homo Sapiens
ctcaggggaagcagcgatggtaggttggagwcttaataaactatccatcttgaaattaaac

SEQ ID NO: 762 - DNA, 61 bp, Homo Sapiens
ttgattgttttcaaccagcattgaagtggcsgctacttatatggcagtgtttgttggaatg

SEQ ID NO: 763 - DNA, 61 bp, Homo Sapiens
tttctattgtttgtggcttgttaattttcaygctactcctaaatggctcatatcttacttt

SEQ ID NO: 764 - DNA, 61 bp, Homo Sapiens
ttggtttagcacacctggaacaaaactggartgaaggaagattttagaggctttccacctt

SEQ ID NO: 765 - DNA, 61 bp, Homo Sapiens
ggagtcttcaataagagacttaacatgaggyatatggaagatgaggcaccgagataagttc

SEQ ID NO: 766 - DNA, 61 bp, Homo Sapiens
ttgctttctataaaaaaagtatcgttttcartgtttcacaaatgttactaatttctaatct

SEQ ID NO: 767 - DNA, 61 bp, Homo Sapiens
cctgattgggatcaaccgaactgaccaaccrgtaagcaacctacattgataccagtgaaga

SEQ ID NO: 768 - DNA, 61 bp, Homo Sapiens
atatttcatttgtgcattccaatgatttaayttagtaagctcaataagcttatctctagtc

SEQ ID NO: 769 - DNA, 61 bp, Homo Sapiens
cagtatattattttctctttgttttttaagrttgaggccatttgctttcgattcaaaggat

SEQ ID NO: 770 - DNA, 61 bp, Homo Sapiens
agtctctaaattttccttctcattttacttyctgtccttgcattcttggcacactgataat

SEQ ID NO: 771 - DNA, 61 bp, Homo Sapiens
aactctctcagcagagttcgtagtcttgtgyttccctttctacttactcatgatctcctct

SEQ ID NO: 772 - DNA, 61 bp, Homo Sapiens
atatagtttcacatagcgctgagagaaaatrtatactactatctctgcacactgaaaacaa

SEQ ID NO: 773 - DNA, 61 bp, Homo Sapiens
tcagtcaacagtctcttaaaggagagtttcracagcagaaagacatttaagtcagagaata

SEQ ID NO: 774 - DNA, 61 bp, Homo Sapiens
gactgtgctaatctatcactagacaaactgrcatagtggttaagagaatgggctttgaagc

SEQ ID NO: 775 - DNA, 61 bp, Homo Sapiens
ttcaaaaagtatttttgtttagcaatgttakaatagtagcagtttcatctttttgatgctt

SEQ ID NO: 776 - DNA, 61 bp, Homo Sapiens
acttaataatgcttaagttctagaatatgamtgcctgaggttcttagtttttttttttttt

SEQ ID NO: 777 - DNA, 61 bp, Homo Sapiens
tctatacttgggaaataacaaaggaccggtraggctagacggcatagatagtggagataag

SEQ ID NO: 778 - DNA, 61 bp, Homo Sapiens
tagcacaaatacaacctaatgtagccaagtyctgagagagcaagcaaattcattcaacagt

SEQ ID NO: 779 - DNA, 61 bp, Homo Sapiens
attgtatccctaacactgtatgaaaatattygcttccctgcatctgttgtcagccaacatc

SEQ ID NO: 780 - DNA, 61 bp, Homo Sapiens
aggatatccctagcaatatgtttttccactrcatatgtttattgttttgaaactattgcat

SEQ ID NO: 781 - DNA, 61 bp, Homo Sapiens
acatttttctttcagagaagccattttaagrtatccaaggcaagccacactatagattaag

SEQ ID NO: 782 - DNA, 61 bp, Homo Sapiens
actacaataaatacctaacccttcaatgccyacataccaagaacatctgctagcaccatcc

SEQ ID NO: 783 - DNA, 61 bp, Homo Sapiens
tattttagtcactattcctgcactctttcgyttattctagagaaaagtgggctaaactatt

SEQ ID NO: 784 - DNA, 61 bp, Homo Sapiens
gctcagcaccttgtgtattctcccgttgacragactgcttcttcaagcttgccctattaaa

SEQ ID NO: 785 - DNA, 61 bp, Homo Sapiens
tgccctattaaaggggagactagtaggatgygctcttctgaaaccaaacagcgttgtgggc

SEQ ID NO: 786 - DNA, 61 bp, Homo Sapiens
ggaaagcagcgtggtcaggaggggttaaacwtcggctgaagcacaggtaagacgcacggaa

SEQ ID NO: 787 - DNA, 61 bp, Homo Sapiens
atttctcggaggaatgtcccaagattccaaygtaagcctaacaaagatttgtagctactta

SEQ ID NO: 788 - DNA, 61 bp, Homo Sapiens
tctctctaaaatctatcaagccttgggctakggtaatgagtcggtaaaggagacaaaatgt

SEQ ID NO: 789 - DNA, 61 bp, Homo Sapiens
gaagttgtgctattctatttatgctgtgctrttcttttgtaattgagtttgtaaattaata

SEQ ID NO: 790 - DNA, 61 bp, Homo Sapiens
ggtttggaatgtgagtgacttcctctctgcstatctatgaacactcagactctgggatagg

SEQ ID NO: 791 - DNA, 61 bp, Homo Sapiens
agtttgcagaagttacctttttactccagcrtatatatttaagcaattagatgatagtagt

SEQ ID NO: 792 - DNA, 61 bp, Homo Sapiens
gcgagctttttagcagttgactcttccctcrctggagtcattcctgctaacctcccatctt

SEQ ID NO: 793 - DNA, 61 bp, Homo Sapiens
ctaatcaagctggatcttaccatctacttgrtttgcctgacaaatattcaaatctgaatat

SEQ ID NO: 794 - DNA, 61 bp, Homo Sapiens
gggaaagacatacagttttcaagttagcctkgcagggaggaaaggaacccaggtgtggcaa

SEQ ID NO: 795 - DNA, 61 bp, Homo Sapiens
tctcttgcttctgtaagtgtcacaaagctgygaatcctgactaaaccaatcttctagaggt

SEQ ID NO: 796 - DNA, 61 bp, Homo Sapiens
ttcatgaatgtgatcatttagattatttttygttatcacacttttccccatcgtgccatgt

SEQ ID NO: 797 - DNA, 61 bp, Homo Sapiens
tctatgtatcacattacaaaacacagtaagrgtgcctcacaaagatttctagcttctgtgc

SEQ ID NO: 798 - DNA, 61 bp, Homo Sapiens
ctgtttaattggtctatatttctgttcttaygaaagcaccctgctgttttggttactacag

SEQ ID NO: 799 - DNA, 61 bp, Homo Sapiens
ttatcttcagtaacctgtgatctaaattacyattggcaagacaagagtgatacctgttttt

SEQ ID NO: 800 - DNA, 61 bp, Homo Sapiens
ggagaaactagtaggcagtataaatccgaargcaaatatattgcaatggagaagggcagtt

SEQ ID NO: 801 - DNA, 61 bp, Homo Sapiens
aaactattagaactgtattcatgacacaaartcggcacagaacattatagttattttttcc

SEQ ID NO: 802 - DNA, 61 bp, Homo Sapiens
attatttagagaatggaaaagcaaattgtgrcactatcaggatacaggatactactcaaca

SEQ ID NO: 803 - DNA, 61 bp, Homo Sapiens
tacaattacctcacctgtgaattagatatcstatcagctgtctcacagtgttgtaaagaac

SEQ ID NO: 804 - DNA, 61 bp, Homo Sapiens
tcccgattcaaatcaaaattggtgagataamaggtagcgataagtctgtttgtggcatgga

SEQ ID NO: 805 - DNA, 61 bp, Homo Sapiens
gagcttgggaggtggaggttatagtgagccraaagtgaaatacatatgcattaactgggaa

SEQ ID NO: 806 - DNA, 61 bp, Homo Sapiens
aaatattccagaacttaaaaccacaaatttrcactgcacttgaaaatacacacacacacat

SEQ ID NO: 807 - DNA, 61 bp, Homo Sapiens
aggaatatattttatttcaaaagcaagattyttcttggcactcaactcatccatgacttta

SEQ ID NO: 808 - DNA, 61 bp, Homo Sapiens
attttatttccttccagttttatttctcaartattgggcgttaatactcacttttagtgaa

SEQ ID NO: 809 - DNA, 61 bp, Homo Sapiens
acatgatgtatgtgatacaaaactctattcwcacatgatgtttttttaatgagtacaattc

SEQ ID NO: 810 - DNA, 61 bp, Homo Sapiens
gccagctgtgcttctggtgtactgaagcttygatcctctcatttcctcatggtggccgggg

SEQ ID NO: 811 - DNA, 60 bp, Homo Sapiens
ctggttgtacattagcattactagagagctkaaaacaaacacagaggaaaagctatggcc

SEQ ID NO: 812 - DNA, 61 bp, Homo Sapiens
gtgtggttcagtatcaatagtttccaaatcrattttattggatcaagaaaatgagatgttt

SEQ ID NO: 813 - DNA, 61 bp, Homo Sapiens
cgtggtacacaatttactggagagacaaatkgctcatgcagatataaatagcatcaaagag

SEQ ID NO: 814 - DNA, 61 bp, Homo Sapiens
atctgttgaaggactgaatagaacaaaaagsctgagtaacagaaaattctgtctctttcct

SEQ ID NO: 815 - DNA, 61 bp, Homo Sapiens
agttaactgctgctaaagcctagcctgttcygaagaaatcaactaaatgggaagctagtac

SEQ ID NO: 816 - DNA, 61 bp, Homo Sapiens
agtatcaacacagcaatgatttggagtcaargaattttagaaagtgaagggattgtggatg

SEQ ID NO: 817 - DNA, 61 bp, Homo Sapiens
cttattcccaacagcctccaaactgctaccrgagttattattccaaaatgcaaatctgatg

SEQ ID NO: 818 - DNA, 61 bp, Homo Sapiens
ataaagattatgaatgcaataataaattcargtaaatgtgaaatgaccatgggctgcagct

SEQ ID NO: 819 - DNA, 61 bp, Homo Sapiens
agtcggccgccctcttcatagtggacgctgragcctttagagtggagggagtaatggattt

SEQ ID NO: 820 - DNA, 61 bp, Homo Sapiens
ttgcttgataacaaaattctatcctcgtgtstgaatagttcatattcacccttttgaatgg

SEQ ID NO: 821 - DNA, 61 bp, Homo Sapiens
tttcagcatatattcccaaaacatttgttcrttgtaaaaacatagccacagtgccattatt

SEQ ID NO: 822 - DNA, 61 bp, Homo Sapiens
atttcctgggatatttgtgtagtgaatagcytagaatgattaagatagtgtctacttctgg

SEQ ID NO: 823 - DNA, 61 bp, Homo Sapiens
aaatggctatattactctgttaccaatggcrtataaatatcacagcaatttgagtcccact

SEQ ID NO: 824 - DNA, 61 bp, Homo Sapiens
ttaaacagaaaataaccaaataatgacagtwattgggcatttgagtgtagtctgtccattt

SEQ ID NO: 825 - DNA, 61 bp, Homo Sapiens
tagtaagttccctttactcaccatctcaatyacttacatgaaaggatttgttttgtcagtt

SEQ ID NO: 826 - DNA, 61 bp, Homo Sapiens
gattctctcttcaatgattcaagctacccawgatggaataaagttaagttctatggcacat

SEQ ID NO: 827 - DNA, 61 bp, Homo Sapiens
taacaagaggggaccacatagtctctgttgrcatttctttgtggtgtctgtctggacatgc

SEQ ID NO: 828 - DNA, 61 bp, Homo Sapiens
acagcccactgctcaccttacacagttcttragcgtttctctcaagtgccttcacagtata

SEQ ID NO: 829 - DNA, 61 bp, Homo Sapiens
attatcagtgcttttatagatgaggtcaacraagattttgctccacactatacaaacaagg

SEQ ID NO: 830 - DNA, 61 bp, Homo Sapiens
ggggccacaaagcagatcagcacacactctyagatacccaggtgtcggctgatagctctcc

SEQ ID NO: 831 - DNA, 61 bp, Homo Sapiens
agtttgacatctgtcaagtattcactatagktttattaagttgaaaagttgagcctgaaat

SEQ ID NO: 832 - DNA, 61 bp, Homo Sapiens
aagtgaaataagccaggcacagaaagggaartaccatatgatctcacttacatgtggaatc

SEQ ID NO: 833 - DNA, 61 bp, Homo Sapiens
tgcaccctttgctgtggagacaatttttatytgatgtactcccatttgtctattttcatgt

SEQ ID NO: 834 - DNA, 61 bp, Homo Sapiens
attcaggattggggttttcctgtcttgttaytggtatgctatgagtaactgatccatctca

SEQ ID NO: 835 - DNA, 61 bp, Homo Sapiens
atctggcagaggtggaataggtaagtaacakgtcagtgtgtgaggaggttcaggaacaatg

SEQ ID NO: 836 - DNA, 61 bp, Homo Sapiens
tctcatagagacatcatgagaacaaaataasaacactgtgaagaggttgtcatacttttaa

SEQ ID NO: 837 - DNA, 61 bp, Homo Sapiens
aatataagagagtgcactgcaatgttttcartgtaaaagccagtgatttagttgaagtggg

SEQ ID NO: 838 - DNA, 61 bp, Homo Sapiens
tgcagctgtaccaggtataaagtagaacagrtgaaaaaactgtccttagtttaacccagtt

SEQ ID NO: 839 - DNA, 61 bp, Homo Sapiens
aatttctaaagaagatttcttccactgctcraaggaaacaaatcgagatgccttgaggcac

SEQ ID NO: 840 - DNA, 61 bp, Homo Sapiens
aactaaagacaaaagggatgaaaagaggtcmgatgccacaaatagtgttactttctttgta

SEQ ID NO: 841 - DNA, 61 bp, Homo Sapiens
tatgagggttggactgaattatagttgactrttactggaagtggaaatccccaattggctt

SEQ ID NO: 842 - DNA, 61 bp, Homo Sapiens
gcagatttttggccagatgcgtttgctctakgatgatcctgagatggctagacagcaaaag

SEQ ID NO: 843 - DNA, 61 bp, Homo Sapiens
gacccaatcgtctccttttaaagtagagaastatgttgtgaagattatacatatgtacata

SEQ ID NO: 844 - DNA, 61 bp, Homo Sapiens
ggttctatttacaaaccaactcttaagacarcatttcttctacttatagggggaaacttct

SEQ ID NO: 845 - DNA, 61 bp, Homo Sapiens
gcatgaacaagtcaggtataaatatatccawctttggaaacaaaatcaggagacattcact

SEQ ID NO: 846 - DNA, 61 bp, Homo Sapiens
tagatggcacaagttctggacctagaaaatrcaaaaggcaatggttaaatcagccctattt

SEQ ID NO: 847 - DNA, 61 bp, Homo Sapiens
aataattacaaaactacatcacctcgtcaaratcactttagaactaaaaaggaagaaaaaa

SEQ ID NO: 848 - DNA, 61 bp, Homo Sapiens
gaaataattgatgatggttgatcaattagcrgaaggatgagtcatatgtcacagttcttcc

SEQ ID NO: 849 - DNA, 61 bp, Homo Sapiens
ctttctcataattatttgcaaaacttaataraagcaaacaggttgctacatgtaccaatgt

SEQ ID NO: 850 - DNA, 61 bp, Homo Sapiens
tcttcctttgtcagcagcatatggtgaaatsagttgaagaaaaaaaatgaacacagcatct

SEQ ID NO: 851 - DNA, 61 bp, Homo Sapiens
ctaggttattactatcttacactggtcaaakaaaaaaccagaagtgtcatttctaaaatta

SEQ ID NO: 852 - DNA, 61 bp, Homo Sapiens
aaaaagaaagaaagaaatagatagaagtccrtttgtcagaaagttctggaaggattcctgc

SEQ ID NO: 853 - DNA, 61 bp, Homo Sapiens
ggacgattggtaaaatttgaaaggggcctayggattagatggtaatttacaatgctaattt

SEQ ID NO: 854 - DNA, 61 bp, Homo Sapiens
tctggttgtatgaattttaggcaatggatcragatatggcaacagttaaaataaaataaaa

SEQ ID NO: 855 - DNA, 61 bp, Homo Sapiens
tagcaaactaatgaaactgataatttggttygaacatgtctctgtcctctcagtgtcttag

SEQ ID NO: 856 - DNA, 61 bp, Homo Sapiens
gggaactgaggcaaatggagatattaggaayaagaatggagatattaggtgtgactcttct

SEQ ID NO: 857 - DNA, 61 bp, Homo Sapiens
gatattagtagttttctgaaggcctgaaaamggataagtacttcagactcattaaaacaaa

SEQ ID NO: 858 - DNA, 61 bp, Homo Sapiens
tcttcctacccaggtgtttttgtcaggctayccttcttcactgaaagccaaggcctttaaa

SEQ ID NO: 859 - DNA, 61 bp, Homo Sapiens
cattcatcagactgatgctccctatatgtgrtaagccatttttctcttggtgctgtcaatg

SEQ ID NO: 860 - DNA, 61 bp, Homo Sapiens
ttccccgattgtcgtatgccttattcaattkccaaagcactgaagtgattgtttttgttca

SEQ ID NO: 861 - DNA, 61 bp, Homo Sapiens
caaaccaggtttacacagagactactatgcytttttcaaaggaaagatgaaaataattcaa

SEQ ID NO: 862 - DNA, 61 bp, Homo Sapiens
gctttctagaacctttagaattctgcaaaawccccagattcaaaaggagcttagaaacaga

SEQ ID NO: 863 - DNA, 61 bp, Homo Sapiens
tgccctgggaagagcaggctgaagacttctyactttgcacgaacatccctgaaaacatttg

SEQ ID NO: 864 - DNA, 61 bp, Homo Sapiens
tacattgcaagctatgccacttctttcctcyctcacttaaagcacctgccaaactaataaa

SEQ ID NO: 865 - DNA, 61 bp, Homo Sapiens
aacataagattaaaaaatgaatagagcatcracaaaatcaaaggttggtttattgaagata

SEQ ID NO: 866 - DNA, 61 bp, Homo Sapiens
atatggtagggacatttatgcttcaaggctkctgtaatagctattttctatgaccaatata

SEQ ID NO: 867 - DNA, 61 bp, Homo Sapiens
aagaaggcacttgttgaaattattactattkggcaaaatcacatccaaaacttactggctt

SEQ ID NO: 868 - DNA, 61 bp, Homo Sapiens
tatgtaaaaatacctgaccttcatctcccartaactacactcagtttaaaattcactcctg

SEQ ID NO: 869 - DNA, 61 bp, Homo Sapiens
aagtttcttttttaacaattgatttgaataraagtaggcagatttagcccttaacctatca

SEQ ID NO: 870 - DNA, 61 bp, Homo Sapiens
cttgagcgagagggatttgcgagatatctaygtctattgtcgtttaaatgtgaatactttt

SEQ ID NO: 871 - DNA, 61 bp, Homo Sapiens
atgcacatatatgtaatcatgtatgtcaagwattagtattcaaaacaaattagtattacta

SEQ ID NO: 872 - DNA, 61 bp, Homo Sapiens
gctaatcatttaggggttatgtatttgtaarctgctgaagttgtgtattattcattaacct

SEQ ID NO: 873 - DNA, 61 bp, Homo Sapiens
attgaaaaagtagccaaatgctttaagaaasggaatagatagagctatagttccaaagttt

SEQ ID NO: 874 - DNA, 61 bp, Homo Sapiens
atttcattctcaaaaaggaatagctattttsatggacaacagatcagtggtggccaggggt

SEQ ID NO: 875 - DNA, 61 bp, Homo Sapiens
tttggataatgcaaactaagaaagtgctaaytggtttccatggtcatacctacagctttat

SEQ ID NO: 876 - DNA, 61 bp, Homo Sapiens
ctacttctgtatttgatgtcacccttcattstcacagttcaaccccaagaaatgtcacttg

SEQ ID NO: 877 - DNA, 61 bp, Homo Sapiens
agggatgccagactcaaagtttgagaattgygccaggttcatagttctgacactagaataa

SEQ ID NO: 878 - DNA, 61 bp, Homo Sapiens
agcaagtgcccacacctggactttttgctgygtgagggaaaaaataaagcctaattattta

SEQ ID NO: 879 - DNA, 61 bp, Homo Sapiens
aaggaagtagaaatttaggcagttaggtttkacccacaacctcatagcctaggtggtaagc

SEQ ID NO: 880 - DNA, 61 bp, Homo Sapiens
tgggaaaattatttaactgcttaacttcttrccagactttcagatcctgctgcttctgtat

SEQ ID NO: 881 - DNA, 61 bp, Homo Sapiens
ggctttgaacaatgacttgtcattagaaggygcccagaaaatggtagttcagggaaattca

SEQ ID NO: 882 - DNA, 61 bp, Homo Sapiens
aagattagtctcctttatacattttccacarttgtttccataaagaaatgttcttagtttt

SEQ ID NO: 883 - DNA, 61 bp, Homo Sapiens
agggacaggctcagcagagacatttttttgrtgagcaagtgtgtcttttactgcttcctca

SEQ ID NO: 884 - DNA, 61 bp, Homo Sapiens
agtggcaaggaagggcacagagaatagctaygacttctgggcccagttttaggagacaaaa

SEQ ID NO: 885 - DNA, 61 bp, Homo Sapiens
catgtctaagaaaatgcaaaagtgcttgcaraatgttgctgttttgcacatattgactttt

SEQ ID NO: 886 - DNA, 61 bp, Homo Sapiens
tgtctttattagcagtgtgagaacagactartgtggtagaatggtagctggtaggggggtg

SEQ ID NO: 887 - DNA, 61 bp, Homo Sapiens
cagtgtactgggtctaagagagattgttgcrtagttagtccagaagagattcaaacatggc

SEQ ID NO: 888 - DNA, 61 bp, Homo Sapiens
attgggttggccaggaccagcagtacaattsagatagggcttgctgagttctagtgttaca

SEQ ID NO: 889 - DNA, 61 bp, Homo Sapiens
cctttttactctcttgtttttaggtgaaaayactgagacacagtgaggttgagtattattc

SEQ ID NO: 890 - DNA, 61 bp, Homo Sapiens
aagatactggtaggtacttggtgtcttcatytcctgctagtgcccgtagatgccttcagtt

SEQ ID NO: 891 - DNA, 61 bp, Homo Sapiens
cttgacttaagtcagttcataatgtgatttyagtggacttttaaattgtcaattcccagaa

SEQ ID NO: 892 - DNA, 61 bp, Homo Sapiens
ttttaacaggaaatgtaaaatattctgctcraatggtttagaaaaatcttctcagaactcc

SEQ ID NO: 893 - DNA, 61 bp, Homo Sapiens
cattaatggtaattctatttttcagtcattsagatcaaaaggccgggaatcctcctagact

SEQ ID NO: 894 - DNA, 61 bp, Homo Sapiens
gtacacaaaaagattgaattaaaaatacatwcttttgtgaactacttgggagaatctattt

SEQ ID NO: 895 - DNA, 61 bp, Homo Sapiens
aacaaccttatctaacatcaaattcgtgttwtcatctttatataaggtagaacaggagtct

SEQ ID NO: 896 - DNA, 61 bp, Homo Sapiens
attcaccaatgaattaacttgatttcaacawgaagtttcacggttaccaaggaggcaaggc

SEQ ID NO: 897 - DNA, 61 bp, Homo Sapiens
tctgcctacataatatttgtgttttgtgtcygatagctttacatttctttaattaaaaaaa

SEQ ID NO: 898 - DNA, 61 bp, Homo Sapiens
gcttgtcactcctttcactattattagctascacatggttcagaactttcacacacattgt

SEQ ID NO: 899 - DNA, 61 bp, Homo Sapiens
ggatagtaagatacatgtacatggttataarggtgagtgtgggtaatgaaatgcttgaaga

SEQ ID NO: 900 - DNA, 61 bp, Homo Sapiens
agaatttttaccaaaaataacctttggtacytgcatgatattttgctaactgcatctgtgg

SEQ ID NO: 901 - DNA, 61 bp, Homo Sapiens
acctccatctctgggctattgcattgtaaamtgttgaggaataagaatcatcctggatatt

SEQ ID NO: 902 - DNA, 61 bp, Homo Sapiens
gcaattacacactattttctgttaaatgacrtggtagaccacctgagaatatttcaaaaat

SEQ ID NO: 903 - DNA, 61 bp, Homo Sapiens
attaaggatagagataaaaaagcaaggagaycagtcttaagagtaacataatcgatgtaga

SEQ ID NO: 904 - DNA, 61 bp, Homo Sapiens
cttcgtattatccaggcttgggtattcctgwagagcaatgcaaatgaactaagacaagtat

SEQ ID NO: 905 - DNA, 61 bp, Homo Sapiens
taatttttcagtttactccagtgatcataawgttttggactatgaattcaattaaagcagt

SEQ ID NO: 906 - DNA, 61 bp, Homo Sapiens
tttagcatcatcttcctcatatcagactctsttttgtcaatttaacatttattctttccat

SEQ ID NO: 907 - DNA, 61 bp, Homo Sapiens
ctattgtgctaagagttgactggagtaacayaggcagaagaaggcaaaccaattagaaaac

SEQ ID NO: 908 - DNA, 61 bp, Homo Sapiens
aacgtgaagtgactgacttaggacggtaatkaggatggtaacatttaatgctatgttctat

SEQ ID NO: 909 - DNA, 61 bp, Homo Sapiens
cttgattgaggtctgtgatgtttaatgttakgtgtcaactcagctaggtgacccagatgtt

SEQ ID NO: 910 - DNA, 61 bp, Homo Sapiens
ctagagatggtttgggttaaaactctatttygtctattattaataaagctacacttatatt

SEQ ID NO: 911 - DNA, 61 bp, Homo Sapiens
ggaaaacatatctgacgctggaagtagaaayagaagttagacaatggctaggctacactga

SEQ ID NO: 912 - DNA, 61 bp, Homo Sapiens
gagcaagtctgctgcattcctttgcacaccsctttcatcaaggaaactttgaataccttta

SEQ ID NO: 913 - DNA, 61 bp, Homo Sapiens
tttttctagtagaaatgctatagttttccaytcttatgattccaaacattgtattttattg

SEQ ID NO: 914 - DNA, 61 bp, Homo Sapiens
tgcagaccttagcgaaatggaataattcagwatccagcaagcccaggaaatattgcccctg

SEQ ID NO: 915 - DNA, 61 bp, Homo Sapiens
aatcagaaaaagaccaaacccagccaaaacstgtctttcattacagtttgttctggttgaa

SEQ ID NO: 916 - DNA, 61 bp, Homo Sapiens
aagcgtcaaaaacccttcagggtgagatttkgaaatggacagatatctgtcaaaagagagt

SEQ ID NO: 917 - DNA, 61 bp, Homo Sapiens
aaaagaggactggcagttcagaggcttttayacagaagaaccacattaaaagttaaagatc

SEQ ID NO: 918 - DNA, 61 bp, Homo Sapiens
ccaggagggtgacagctgtgcatcaggaatkaagggcaagttcagattgaagcctcgtgtc

SEQ ID NO: 919 - DNA, 61 bp, Homo Sapiens
catcatcatcatcatcatccccctcacaatwaccgtgtggtggttaattttgtgtgtcatg

SEQ ID NO: 920 - DNA, 61 bp, Homo Sapiens
taaacacccagatttaatctgacctacaaarcaaatagggctaaaacactgggcacgttta

SEQ ID NO: 921 - DNA, 61 bp, Homo Sapiens
  misc_feature (31)..(31): n is a, c, g, or t
agaacatttacacactttcaaatgatcctgntaactattccatacatatgatatcattggc

SEQ ID NO: 922 - DNA, 61 bp, Homo Sapiens
aaaccccttcttttctgtcttgggggcttcrgtaactggtatgtccaaatatggcagatat

SEQ ID NO: 923 - DNA, 61 bp, Homo Sapiens
ttacagtgagtgccacttcatctcatttcaytgcgtttactcattaaattatgaaaaatta

SEQ ID NO: 924 - DNA, 61 bp, Homo Sapiens
gattaaagtgtctgatgtatataaaatacartcggcacagcagcactgcttttagaacaag

SEQ ID NO: 925 - DNA, 61 bp, Homo Sapiens
gactaaattccatttacagtagcattaaaarccataacacttaggaatacatttaacagaa

SEQ ID NO: 926 - DNA, 61 bp, Homo Sapiens
taaaaacaagattgccacaagaaagaaatawgtttgctgagatttaaaagtctttatgtta

SEQ ID NO: 927 - DNA, 61 bp, Homo Sapiens
ttgttgatttcctaaatctcatttgaccacytgtctccatttctattctcactatcctaga

SEQ ID NO: 928 - DNA, 61 bp, Homo Sapiens
gcagttactaaatgccccagtacttcagaamcccagagcattctcaaacacatgttttcta

SEQ ID NO: 929 - DNA, 61 bp, Homo Sapiens
taaacccagacaaaatttttgaagagtttcmtgaatccaaacatgtttacactataataaa

SEQ ID NO: 930 - DNA, 61 bp, Homo Sapiens
tctaagttagttcacacctccgtaccaatastgaatgttgaaaatgttaacgttgcccatt

SEQ ID NO: 931 - DNA, 61 bp, Homo Sapiens
ctctccatgttacttgtaattattatgtccstattgtgattcattagagaagtggccaata

SEQ ID NO: 932 - DNA, 61 bp, Homo Sapiens
atatgggtctccggcttctcatttgggtggyttattgtccctcattcaagcttttcaattt

SEQ ID NO: 933 - DNA, 61 bp, Homo Sapiens
ataggctaacaggatacttctttgggatacygtgtcttctggaaagaagttatctatagct

SEQ ID NO: 934 - DNA, 61 bp, Homo Sapiens
gagacatttgtgttcatggacataggtgctrtaagttatgttaatggaactgattgttctc

SEQ ID NO: 935 - DNA, 61 bp, Homo Sapiens
taagccggctgttgggagctgccgaaggccycatcttttatagtcacagagtcctgtggtg

SEQ ID NO: 936 - DNA, 61 bp, Homo Sapiens
gagccacgcacttaagaatagggaatgaaarctcgctttttttgtggataaaggaaagctg

SEQ ID NO: 937 - DNA, 61 bp, Homo Sapiens
atagtaatatggccaccccaactttcgtatsattactgtttgtgtggtattatcttttcca

SEQ ID NO: 938 - DNA, 61 bp, Homo Sapiens
tactgagaaaggggtactgaaatctcaactrtaactgtagatttgtctatttcttttcact

SEQ ID NO: 939 - DNA, 61 bp, Homo Sapiens
ccccacttccataaatacttatcgacactgmctaatataaattataaagttataaattaaa

SEQ ID NO: 940 - DNA, 61 bp, Homo Sapiens
acattattgaatgctcttagaagattgtaarattgctctctggaagtgtgggggaaggtgg

SEQ ID NO: 941 - DNA, 61 bp, Homo Sapiens
agtcgacgtggtgcagggcagagaagcgctygtccacatcatctatttggccacaggtagg

SEQ ID NO: 942 - DNA, 61 bp, Homo Sapiens
actgagaaaattctgattttcgtcatttagkttattgccctaaattcaagaacattcattc

SEQ ID NO: 943 - DNA, 61 bp, Homo Sapiens
tgatatatttccctgggtgagttgaaatgakattatctcctagaggtaggggaagggtgaa

SEQ ID NO: 944 - DNA, 61 bp, Homo Sapiens
catagcattacagtcattcatttgagtttcmttccacgagcaaccatttttgagtacctag

SEQ ID NO: 945 - DNA, 61 bp, Homo Sapiens
ctttttttaagaactggttttgccgggactrgtaatgccttctgtaaaatcccataaccta

SEQ ID NO: 946 - DNA, 61 bp, Homo Sapiens
catagttacaacttacatctgggcatatatmctttcagatgtttttctgttagaggccata

SEQ ID NO: 947 - DNA, 61 bp, Homo Sapiens
ccgtgtgtggggagaccctcatttcatggcyatccagtcaagaggttggatatgaaccttc

SEQ ID NO: 948 - DNA, 61 bp, Homo Sapiens
tgtggctatcacggcaaaagacagcatttcktctaggaggagacagacagagagcctcaaa

SEQ ID NO: 949 - DNA, 61 bp, Homo Sapiens
gccctgggtattgtacgatgctcaactactwcttcatccactgacaaaaactgttcatgat

SEQ ID NO: 950 - DNA, 61 bp, Homo Sapiens
caactctgacagtcttctcatttgtaagccygataatcattataccagtaaagttgcatat

SEQ ID NO: 951 - DNA, 61 bp, Homo Sapiens
tgcacctagacattaaaactttacgccctaygaaaacgatgacaatttttaagtgacaaca

SEQ ID NO: 952 - DNA, 61 bp, Homo Sapiens
caaaattaaagagctgccttaactgagatgrtccgacaacagggataattctgggaacaaa

SEQ ID NO: 953 - DNA, 61 bp, Homo Sapiens
ccaagaatgattaaagatatgctctaaatakcttaagaacgttagtaggaatttcaattca

SEQ ID NO: 954 - DNA, 61 bp, Homo Sapiens
atacatccaatttaatgaatctggatagaawgtcatgaatggtcatggagggtgcaaaatc

SEQ ID NO: 955 - DNA, 61 bp, Homo Sapiens
tattcgtacttacacaggccatatgtttggkatgagtgagatcatgagtaaaatatgttgg

SEQ ID NO: 956 - DNA, 61 bp, Homo Sapiens
tgctctgtgtctgacactgcgctgagtgttktaagcatatttcttattgaatctttatagt

SEQ ID NO: 957 - DNA, 61 bp, Homo Sapiens
gttccttaactatagtctattttttttggtyggtgttgtcagctacctagaaacccctttg

SEQ ID NO: 958 - DNA, 61 bp, Homo Sapiens
tgttatcagtatatatccctctctgaacttyggtgaatggaaaagctctagcaagtgcagt

SEQ ID NO: 959 - DNA, 61 bp, Homo Sapiens
tgcgggcctgccaaaaacagtatacaagtcrgtaaaagtcattccaactctttcatgtaga

SEQ ID NO: 960 - DNA, 61 bp, Homo Sapiens
caacaatcaatgtaaatggcttaaacttgcrattaaaggaaagagagtctcagctgttttt

SEQ ID NO: 961 - DNA, 61 bp, Homo Sapiens
cctggcacatagaatgagctagctttgttaygactcattctaacactgaactcgctcctcc

SEQ ID NO: 962 - DNA, 61 bp, Homo Sapiens
atgccagagcattgtcaggaggcagggaaayagactccataactttatggaagttgctgta

SEQ ID NO: 963 - DNA, 61 bp, Homo Sapiens
ataaggtatccattgtatatagcatgattgratcgcatttcctagatgttgtaaaagcctt

SEQ ID NO: 964 - DNA, 61 bp, Homo Sapiens
agattcctaggcttgaaatgcaagagggttrtggtatctgtttgggagtcttagggagttt

SEQ ID NO: 965 - DNA, 61 bp, Homo Sapiens
gcaaacatttgtttactacgaagcatcggasttgaaatggaggggacagcctggccttggt

SEQ ID NO: 966 - DNA, 61 bp, Homo Sapiens
taaacaaatgtttgctcaggtttcccagctmtccttttacagtacatgaagaggaaattaa

SEQ ID NO: 967 - DNA, 61 bp, Homo Sapiens
aataaggaaaaatatttttatgacttatacrctaagcttacaacaatccctggcaaatccc

SEQ ID NO: 968 - DNA, 61 bp, Homo Sapiens
atcaaagagggtcaagctattgagtcctggytgattttttccccttccatgcctctagtca

SEQ ID NO: 969 - DNA, 61 bp, Homo Sapiens
tttttgatcttattagcaatagatttaaacsacttgagttagaggtataaaaattttaacg

SEQ ID NO: 970 - DNA, 61 bp, Homo Sapiens
tgggttgagggcctcagttctttgctagccrttgtctggaagccaccctcagctcattatg

SEQ ID NO: 971 - DNA, 61 bp, Homo Sapiens
caaaacataaagtagaatgtttttacagccrtagaaggcaaagggctaggaattcacagga

SEQ ID NO: 972 - DNA, 61 bp, Homo Sapiens
cctctggagtctggttttgtgtctctggcaracccatttcctcagaaacttacttggcagg

SEQ ID NO: 973 - DNA, 61 bp, Homo Sapiens
ttttgacggggtgagtgtcacaggacaattkaccgtatttccccgaggctgagcagctgtc

SEQ ID NO: 974 - DNA, 61 bp, Homo Sapiens
cccattcaattagagcagccacacttggatytattttacattgtaatgattgaagaaggaa

SEQ ID NO: 975 - DNA, 61 bp, Homo Sapiens
attcacgaaacaaaccagtgcaaagcaaacrcagtacacccattccaatgtaattccaatg

SEQ ID NO: 976 - DNA, 61 bp, Homo Sapiens
ctggtacctcgacccaggtactctgtgttaygctgatcttcactgcttcatacctccacgc

SEQ ID NO: 977 - DNA, 61 bp, Homo Sapiens
ttagacacaatattttctctccttctaacckgacaaatatatagtacactttcataatgac

SEQ ID NO: 978 - DNA, 61 bp, Homo Sapiens
ccagcctggctgtaagctgctatgctcacaygatattcagtgcctggtttcaaatctccaa

SEQ ID NO: 979 - DNA, 61 bp, Homo Sapiens
ggaggaataacctccaaaatttttttcctcygtaaaagcaatgagaatattggcaaaaatg

SEQ ID NO: 980 - DNA, 61 bp, Homo Sapiens
ccaaataatagactcccttcccttgatgcayttattttgtattaaagacaaatggtatttc

SEQ ID NO: 981 - DNA, 61 bp, Homo Sapiens
tcatctgttcaggctggttagttcccctttycaatccacacagagaaagacagaaaagaca

SEQ ID NO: 982 - DNA, 61 bp, Homo Sapiens
gatgatacagtttttaactgctggatcagcracgcctatttcaagtagtgatactaactaa

SEQ ID NO: 983 - DNA, 61 bp, Homo Sapiens
aaaaacatagctttaattctttcgaaagaartataagttgacagaaaaggtagccttatgt

SEQ ID NO: 984 - DNA, 61 bp, Homo Sapiens
agtttgctctgaagtgtaatttatatctttkgctcagaagccacatgctttctcagtagca

SEQ ID NO: 985 - DNA, 61 bp, Homo Sapiens
tataatgaacatagtaatttggtgtctttcmtgttaaattagggcacagattttcactaaa

SEQ ID NO: 986 - DNA, 61 bp, Homo Sapiens
aatttcaggtttgaaaactcaaaccaacagraagatatcacacctttgtatgtgcttcttt

SEQ ID NO: 987 - DNA, 61 bp, Homo Sapiens
agaggaagtcactggaagagaaatgaaaacmcagaggtagaggagaacacacatctatttt

SEQ ID NO: 988 - DNA, 61 bp, Homo Sapiens
attttcttggaatagcctcttggtgatgtcmtagcctcttcttatgagggtgagttgtcag

SEQ ID NO: 989 - DNA, 61 bp, Homo Sapiens
acacatcaacattattttgaatattcaacaytggatagccaaataaatagcataatttatc

SEQ ID NO: 990 - DNA, 61 bp, Homo Sapiens
ttagcttccttttgtgaagattagtgaaacrtagccattttgatcacactgtatggaaaat

SEQ ID NO: 991 - DNA, 61 bp, Homo Sapiens
ttgcacagatagtatggtttacatttcatcwtttttgaggatgtccccattaagttatgat

SEQ ID NO: 992 - DNA, 61 bp, Homo Sapiens
atgcaaataaagccattataagtgcacatcrtttattgaaatatgcacacacacaaacatt

SEQ ID NO: 993 - DNA, 61 bp, Homo Sapiens
aaagaaaacatttagatattgaaaacttccsctaagtatgcagctagttattttgtgatgc

SEQ ID NO: 994 - DNA, 61 bp, Homo Sapiens
tctgaagttatactgatgtgatataacaagstgaaaggttcagggccatgggtggtcaagt

SEQ ID NO: 995 - DNA, 61 bp, Homo Sapiens
gcactggtttaagcacacacagattctggaygggtcttcagaaccatttgctcttgtcaca

SEQ ID NO: 996 - DNA, 61 bp, Homo Sapiens
aagaagagtgactatcccaggcttttagaartggaatgccatcacagaccctgaggctcac

SEQ ID NO: 997 - DNA, 61 bp, Homo Sapiens
gatcagaagacctgagagacataatggagtktcaattctaatttgctgttggctccttgaa

SEQ ID NO: 998 - DNA, 61 bp, Homo Sapiens
gcaagttatggtgttcttcaatgattatgcyttggtgtgatttgcttggatgtgtctttag

SEQ ID NO: 999 - DNA, 61 bp, Homo Sapiens
ataacacatgtgtggaaccagaatgggaagygacttgaaagtaacatcatctctcaaaata

SEQ ID NO: 1000 - DNA, 61 bp, Homo Sapiens
catagccctgctttatagaggcaaaagtggkatctcatgctatatggcacagcagaaacag

SEQ ID NO: 1001 - DNA, 61 bp, Homo Sapiens
gttttatttctggcttttgcggatcattttktatgctgttcctctcacctgaagctccctt

SEQ ID NO: 1002 - DNA, 61 bp, Homo Sapiens
caatgcatagttgtttcccttgattcctcaratgtttgccatttaacctgctgactgcaat

SEQ ID NO: 1003 - DNA, 61 bp, Homo Sapiens
ctaacatctaaaaagtgtagaaagcaccgtyattataggctaaaattgatctcatttatcc

SEQ ID NO: 1004 - DNA, 61 bp, Homo Sapiens
aagaacttttttcactagattcctagaattygagagctccagaagcagcacagctgttggc

SEQ ID NO: 1005 - DNA, 61 bp, Homo Sapiens
gattgtgtgtgttgtggtggagaaagtgaamaattacaagaataaaaaaaatcacatgtat

SEQ ID NO: 1006 - DNA, 61 bp, Homo Sapiens
tctcctggcttccaggtatgttcttaacacsttactacaacatgctgtcccctaagaccat

SEQ ID NO: 1007 - DNA, 61 bp, Homo Sapiens
tcaacaaaactgacaaacctttagctgcacraaggaaaaaaaagagtattcataaataaaa

SEQ ID NO: 1008 - DNA, 61 bp, Homo Sapiens
gttcacgatcaaggtgccagcaagataaggyctcattctgaagtctcttctcttggcttgc

SEQ ID NO: 1009 - DNA, 61 bp, Homo Sapiens
tcgctgaacgaatgatctcaaccccacgtgwctctctagcttcatctcttgcctaacagca

SEQ ID NO: 1010 - DNA, 61 bp, Homo Sapiens
aatttgcctagaaattatttgcagataggcrctttcttttatgcacatttgaaaaccctat

SEQ ID NO: 1011 - DNA, 61 bp, Homo Sapiens
aagataagacaatgaaagagaagtcgaagtsaggcccggcacggtggctcacgcctgtaaa

SEQ ID NO: 1012 - DNA, 61 bp, Homo Sapiens
aggggaaaggggggactttccgggaacttaygtagaatatattggaaggaaaaaaatctcg

SEQ ID NO: 1013 - DNA, 61 bp, Homo Sapiens
agataacatggtgtgatagcttgaaatgagragcataattgcatgatggattatatctgaa

SEQ ID NO: 1014 - DNA, 61 bp, Homo Sapiens
ctctaaacctgctgatgttacaccgctcaayggattttctgaaggatcaaaaacagatgcc

SEQ ID NO: 1015 - DNA, 61 bp, Homo Sapiens
aattgatccacagatttaatgttattccaasgtaaattccaacaaggcttttcataaaact

SEQ ID NO: 1016 - DNA, 61 bp, Homo Sapiens
ggggatccactttcaaaatgtctcattcacwtgacggcaccttggggctggctgtaggcca

SEQ ID NO: 1017 - DNA, 61 bp, Homo Sapiens
aaccacaagaaaaatagcagtagacacttawtagagtgataaaaatttaaaaggctgacta

SEQ ID NO: 1018 - DNA, 61 bp, Homo Sapiens
tgttgatatctgagaagcggtttggttcctwagtaatacctgaggctactttgataatctc

SEQ ID NO: 1019 - DNA, 61 bp, Homo Sapiens
gcagatttcttacatgtatatattgcatacyggcagaatctgggcttttggtgtacccatt

SEQ ID NO: 1020 - DNA, 61 bp, Homo Sapiens
tatgagtgctctgtcttctacaccgttgtcrgaattaaatttctaaatgttttcagaaatt

SEQ ID NO: 1021 - DNA, 61 bp, Homo Sapiens
ttttcactaaccgagcactaattcagtagtrgtcaaagtgtggtccttggacctgcagcat

SEQ ID NO: 1022 - DNA, 61 bp, Homo Sapiens
atcaaaaataaacaaaactagttttgctctmagtaccacccagacttcaatgattccatac

SEQ ID NO: 1023 - DNA, 61 bp, Homo Sapiens
gatgactgctggcctggtttctctttcatcytcagctttgacatgggacctcctggtttaa

SEQ ID NO: 1024 - DNA, 61 bp, Homo Sapiens
acagaaacagtccctatttctatggagtttrggatattagggggagttggaaggacaaaca

SEQ ID NO: 1025 - DNA, 61 bp, Homo Sapiens
gtctcttgtttccaaggcgatttaagttttmgtgcatggtttgtacactttgcaacaaggt

SEQ ID NO: 1026 - DNA, 61 bp, Homo Sapiens
aatcaaatatatgtattgtaaatgtaaaccrtaatctaacctgtgttaactatctcgttaa

SEQ ID NO: 1027 - DNA, 61 bp, Homo Sapiens
acatgtttcagcctcttgcctaaaacccacrccttaggatatagcccagcagtgtgtccat

SEQ ID NO: 1028 - DNA, 61 bp, Homo Sapiens
cacactttttatcaagtactttcccatcatsctcatgtatcagcacattttcttaggagaa

SEQ ID NO: 1029 - DNA, 61 bp, Homo Sapiens
cctaggactagggatggctgcaggtttcaargagcgagtagcttgaatgtgtgattcaagg

SEQ ID NO: 1030 - DNA, 61 bp, Homo Sapiens
aggccatgcagcagagcctcatagccagctygctgcctggaattgaccctaagaccaacgg

SEQ ID NO: 1031 - DNA, 61 bp, Homo Sapiens
aattacatatattaactactactttaactcktagtaaccctaatttccatggaaaaaccta

SEQ ID NO: 1032 - DNA, 61 bp, Homo Sapiens
gcctttggaagtaacttttcatcttcagttkgctggatccagaacttgcacaaaaaccgag

SEQ ID NO: 1033 - DNA, 61 bp, Homo Sapiens
ggaatagggaggtctaagaagagggagagaytggaaaccgctagttggtggaacagttaga

SEQ ID NO: 1034 - DNA, 61 bp, Homo Sapiens
gttttctagtttatttgtgtaatggtgtttrtagtagccttgaatgatctttgtatttctg

SEQ ID NO: 1035 - DNA, 61 bp, Homo Sapiens
actgttttgtagtgacacctctgttagataycaagtttctgcatttgtgtgggtttgtttc

SEQ ID NO: 1036 - DNA, 61 bp, Homo Sapiens
tctgagttattgctgttattttcttcgttakctaagcatggctcacaaggctttttctgtt

SEQ ID NO: 1037 - DNA, 61 bp, Homo Sapiens
ctctgcctaatgacctccatcacattaccartatgttatcgatctgtgatgatgctggctg

SEQ ID NO: 1038 - DNA, 61 bp, Homo Sapiens
gatagactctattataaatttagaattttcsaatcttcttccaaaaaaacacatatgcaaa

SEQ ID NO: 1039 - DNA, 61 bp, Homo Sapiens
acttttgatacatgccacaaaactgggtgamtctcagaatagctgtgctgagtaaaataag

SEQ ID NO: 1040 - DNA, 61 bp, Homo Sapiens
tggaaattgaaagtttgtccttgtgaggttrgaataacgatatctagtgttagcatgacga

SEQ ID NO: 1041 - DNA, 61 bp, Homo Sapiens
atctttggatttaccagtatatgtatttgtsagtgctctttttcttcctgaccatttgaca

SEQ ID NO: 1042 - DNA, 61 bp, Homo Sapiens
ccgtatcttggtgcagaacagataattatasagagatggaatgggacaaccgcagttttac

SEQ ID NO: 1043 - DNA, 61 bp, Homo Sapiens
catcttggctctgagttctgtttctttacckaccttaactgaaattctctgggtttacccc

SEQ ID NO: 1044 - DNA, 61 bp, Homo Sapiens
agataaatctatgtgggatgttaactgatartcagaaggttgctttgtgagaatgcagtca

SEQ ID NO: 1045 - DNA, 61 bp, Homo Sapiens
agaaagatatgtgctatttaagtgtcagagstaggattgtttaggccagtgattttttttt

SEQ ID NO: 1046 - DNA, 61 bp, Homo Sapiens
gataatatataattaatattgttatttgctrtaggttatcagaccaggatgaagagggaaa

SEQ ID NO: 1047 - DNA, 61 bp, Homo Sapiens
taggtccttgttaaataattatcagactcawtttgattcaacagataacatattagaatct

SEQ ID NO: 1048 - DNA, 61 bp, Homo Sapiens
tgagctacagtggaagtgggccccattctgyggtgatactttgttttaactcacaactact

SEQ ID NO: 1049 - DNA, 61 bp, Homo Sapiens
gcagtttctctcagttggtatgctaaatttcrggccttgtggcactctgatcaccttctca

SEQ ID NO: 1050 - DNA, 61 bp, Homo Sapiens
ttgcttgtttgttttcaggaaaactgtagtraaaatgagaaaaggctagaagaacagaatg

SEQ ID NO: 1051 - DNA, 61 bp, Homo Sapiens
aacttgccctcagtcaccccaagtcttaaasaaaagccatgttaaccactaacgatggcag

SEQ ID NO: 1052 - DNA, 61 bp, Homo Sapiens
tctattcacagaggttttcctaaatattccrgcctagctcactgatgatttaactaaatta

SEQ ID NO: 1053 - DNA, 61 bp, Homo Sapiens
taacttcctagagagtgttttagcagatttyagagccctttgtttatcctgatttctgact

SEQ ID NO: 1054 - DNA, 61 bp, Homo Sapiens
gttactttttagcagctgcagtttttttctraatcaagtcatctcactttgtaaaaaaaaa

SEQ ID NO: 1055 - DNA, 61 bp, Homo Sapiens
attgaggaatatgggcataaattacaatatrctaacaggtgactgcaatattaaattttct

SEQ ID NO: 1056 - DNA, 61 bp, Homo Sapiens
aaagttctggaagaatgcacattggatcttktttctcatactttagggagagagacatgta

SEQ ID NO: 1057 - DNA, 61 bp, Homo Sapiens
gcagtttagtagagaggcgtgaggcaaaagwgaatggatagtcttagtatttaagcagcac

SEQ ID NO: 1058 - DNA, 61 bp, Homo Sapiens
atttaagtgactgcattgtacttattgcagmaaaatacatgctttgcaaagataagtttag

SEQ ID NO: 1059 - DNA, 61 bp, Homo Sapiens
taatcattagctttggaaagtgagatcttcmtggtaaatgtaaggactacactattcactt

SEQ ID NO: 1060 - DNA, 61 bp, Homo Sapiens
atacaggtaggaattaaagatctgaagaagycaacaataggaaagatgaattttaatggat

SEQ ID NO: 1061 - DNA, 61 bp, Homo Sapiens
gaaagctttaaatatggtttgagattggtgytttaaattatattgcagttgtgaaatctgc

SEQ ID NO: 1062 - DNA, 61 bp, Homo Sapiens
aagctcattacactttgtaagcatcataaaytgtctagttgccctctacatgaagtgaaaa

SEQ ID NO: 1063 - DNA, 61 bp, Homo Sapiens
atcaccccttacaggtcccaattctcaacamggttgcatttgcgattaaatttcccacatg

SEQ ID NO: 1064 - DNA, 61 bp, Homo Sapiens
agcatgtgacagtcacctcatcctcaaatayaaatcttaccttgctttctaacacactaca

SEQ ID NO: 1065 - DNA, 61 bp, Homo Sapiens
aattacccatcttataactgaaagttggtastctttaatcaaaatcccccatttctctcac

SEQ ID NO: 1066 - DNA, 61 bp, Homo Sapiens
ctgtgaaggagatcaccagggcttggctagrtcacagctctgtggctgcatctaggtgggg

SEQ ID NO: 1067 - DNA, 61 bp, Homo Sapiens
gaaacaaccagtgacaaaatagtatcacttyatgattagacctcatgaatcctaacacatt

SEQ ID NO: 1068 - DNA, 61 bp, Homo Sapiens
cagagagtaagtaatatacatacagctgttsggaaataccattatttctaagaccagacaa

SEQ ID NO: 1069 - DNA, 61 bp, Homo Sapiens
gtgatgaaaaagttctggaaacatggatagyggtgacagttgcacaacattgtcagtgtac

SEQ ID NO: 1070 - DNA, 61 bp, Homo Sapiens
ctaaaggtatatatatagaattattattgaygattatcagtattatatcactgatggatag

SEQ ID NO: 1071 - DNA, 61 bp, Homo Sapiens
tgggatggatgaataaagcgcttatctccaytagtgtctccacagtgaatattaccattgt

SEQ ID NO: 1072 - DNA, 61 bp, Homo Sapiens
ctttccctctgaagaagaattagccttctcstcttccaaatgtgacttttctgtttgtgga

SEQ ID NO: 1073 - DNA, 61 bp, Homo Sapiens
tggcattttataatgtcctgtaggagttaartgtgtatgcagaaatggtcttaaaattgta

SEQ ID NO: 1074 - DNA, 61 bp, Homo Sapiens
tagccttccacctggtggccctggactagamctccagagaattccaggttgtgcaagatgg

SEQ ID NO: 1075 - DNA, 61 bp, Homo Sapiens
gctgcaggaaggctgtcctaactgtttagcytaggaactgtgagataaaatcaccaagccc

SEQ ID NO: 1076 - DNA, 61 bp, Homo Sapiens
ttttgttgacaaccatcgctttcctatgtgwgactctgttggaaattttaggatttccggt

SEQ ID NO: 1077 - DNA, 61 bp, Homo Sapiens
aaggttttgaaattagaaagatatatgtaasgagttgtcagctcttatttcttcctccagc

SEQ ID NO: 1078 - DNA, 61 bp, Homo Sapiens
cgtagtatatgctatgcaggttgtatcacaytatcaacggattattacagatctgaaaggt

SEQ ID NO: 1079 - DNA, 61 bp, Homo Sapiens
aaatattttgcttaggtttgtatcatttaawtacagatgggagagtggatttctaatcttc

SEQ ID NO: 1080 - DNA, 61 bp, Homo Sapiens
ccaggagcccctttagaatcatggagaacaytttcgttcatcagtatagacttcacacaac

SEQ ID NO: 1081 - DNA, 61 bp, Homo Sapiens
aattttgttttaatccagatctcatgacttmtttctcattctctttccttcctgaacaatt

SEQ ID NO: 1082 - DNA, 61 bp, Homo Sapiens
acaggtttgtgagagtaggcactttgtaaayattaaatggacagcagctcaggttatacaa

SEQ ID NO: 1083 - DNA, 61 bp, Homo Sapiens
agcccacttctccaacagcatctctcatcamtcttccccagctactatgctcctactgttc

SEQ ID NO: 1084 - DNA, 61 bp, Homo Sapiens
ggcgaatacccagttgtcccagtacattttrttgatgagtccttttttgtttttgtttttt

SEQ ID NO: 1085 - DNA, 61 bp, Homo Sapiens
taagtcttagggagcagtgttccaagtaccyggcagaagcaaagctaattcctcccagttg

SEQ ID NO: 1086 - DNA, 61 bp, Homo Sapiens
ttttggggccctcttgccctgcatcagtttygagtgtttggttaagctgtatttggcccca

SEQ ID NO: 1087 - DNA, 61 bp, Homo Sapiens
cagagcatcctgctcattctgctaaatggcwttttaataataagcaatattatgttgtgct

SEQ ID NO: 1088 - DNA, 61 bp, Homo Sapiens
ttaggctatgttagggttggtctatttcagstttgcctttattgctaggatatatccctta

SEQ ID NO: 1089 - DNA, 61 bp, Homo Sapiens
gtgaatttcataagttaaagctaccattctsctgttttggctgtttctgctgcagactcag

SEQ ID NO: 1090 - DNA, 61 bp, Homo Sapiens
aatagacacttagctgttgtatttttctacrtggaatttcatatagagctattttccaata

SEQ ID NO: 1091 - DNA, 61 bp, Homo Sapiens
gtgcaataattagcagttaggtcagtatccrgcacatagtgagcattcaataattagtgac

SEQ ID NO: 1092 - DNA, 61 bp, Homo Sapiens
cctgaactacccgggagaccacaggaaacaytggaacgtgaatttatcaacttaaaatgaa

SEQ ID NO: 1093 - DNA, 61 bp, Homo Sapiens
taacagattgctggatcatgtccaaaattayaaataagacagaacttatatcaaatggtgt

SEQ ID NO: 1094 - DNA, 61 bp, Homo Sapiens
gtaaggggtaaccattataccattttacagrtttactaacatgacactaggaaaggcacgg

SEQ ID NO: 1095 - DNA, 61 bp, Homo Sapiens
ttaagattagaggtttattctgtatggaaaratccttatttctaccccatatacatttatg

SEQ ID NO: 1096 - DNA, 61 bp, Homo Sapiens
cctgtcactgtgaatctgctctagaggattcrtggagtcacagttgtgctttgattctctg

SEQ ID NO: 1097 - DNA, 61 bp, Homo Sapiens
aggtaagcgacctgatttctcctcgttgcayttgcttttgcttgtttcatcctgtcactgt

SEQ ID NO: 1098 - DNA, 61 bp, Homo Sapiens
gctagattcagtatgattcttcttacatgargtggcaaatttttcaccatttgtattagat

SEQ ID NO: 1099 - DNA, 61 bp, Homo Sapiens
agtcttcctatgacagtaaatgaagctccayccttctagtgggacaaccaaaagccaaaga

SEQ ID NO: 1100 - DNA, 61 bp, Homo Sapiens
tcagggagattcatttacaacaaagcaaatygcctggcttctttactcagaaccttccaag

SEQ ID NO: 1101 - DNA, 61 bp, Homo Sapiens
aggtcattttgcttcatcctttagattttawggacctaacactactgttctctctgagtaa

SEQ ID NO: 1102 - DNA, 61 bp, Homo Sapiens
gggcagcttgtatccaaacaatagtagatgytgagagtaaatggcctgattttctcaccaa

SEQ ID NO: 1103 - DNA, 61 bp, Homo Sapiens
aaagtcaatgaccaatggtctaccaactttrttttacagattagttcatgcatgcaaatat

SEQ ID NO: 1104 - DNA, 61 bp, Homo Sapiens
tgaaagacaagtgaacataaaattataaatstgactagagctaaacgatatggatacagat

SEQ ID NO: 1105 - DNA, 61 bp, Homo Sapiens
tctatccagtagttcatgtaaaaactgacartcttccttgatccttcactttctttactgc

SEQ ID NO: 1106 - DNA, 61 bp, Homo Sapiens
tgtgaatctagatttgaacccgaggcatctrgggatagcatctgggttcttaggcactgaa

SEQ ID NO: 1107 - DNA, 61 bp, Homo Sapiens
gacagttaacttacttgcagatcagcttaasttcttgaggctttttaaaagctttgtcagt

SEQ ID NO: 1108 - DNA, 61 bp, Homo Sapiens
ttatgagcacttttgcataatttgctaaccmtatttatgaagttgctcattgctgtagctt

SEQ ID NO: 1109 - DNA, 61 bp, Homo Sapiens
gcctaacctaatcaggtgagtccttaaaagrgttggggctctacctggaggagactggaag

SEQ ID NO: 1110 - DNA, 61 bp, Homo Sapiens
gggcagtacagagaaaaagcactgagctaawgctgacacagcggtaattcaaacccaaaac

SEQ ID NO: 1111 - DNA, 61 bp, Homo Sapiens
ttcagaacagctgacctacccaggtctcctraacagttatcggtaaagtctcaaacatgcc

SEQ ID NO: 1112 - DNA, 61 bp, Homo Sapiens
ggctagagaaggccagccctgatggccaacrtcctagcagaatataaggtgcttatccaat

SEQ ID NO: 1113 - DNA, 61 bp, Homo Sapiens
attttaaatattactgatttttgtcattgartttgtaagtctatcataagctttgcaaaaa

SEQ ID NO: 1114 - DNA, 61 bp, Homo Sapiens
agtcttcatctgaatagactgcaccagcgtrtggctgcccaaagtaaaaaatgcatggtgg

SEQ ID NO: 1115 - DNA, 61 bp, Homo Sapiens
accctcaaagggtcaaccaagttcacatccrtgtctttctcctcttttcctcatctcccat

SEQ ID NO: 1116 - DNA, 61 bp, Homo Sapiens
atagataaatttttacattctactgccaggwggatcaaatcacaaaattatttaccctata

SEQ ID NO: 1117 - DNA, 61 bp, Homo Sapiens
acccagggagcctggcagagccaggaaaagkcacctcaacatttcagggtctggaaggctc

SEQ ID NO: 1118 - DNA, 61 bp, Homo Sapiens
aagggcaggaagattttatcaaacttggaarctctccctggataaatttcacagatatata

SEQ ID NO: 1119 - DNA, 61 bp, Homo Sapiens
agggaggaataataaggacatgaacttttarggctgatgtaaataacacttcgctcattta

SEQ ID NO: 1120 - DNA, 61 bp, Homo Sapiens
gcctgttgaataaacatttttagcccttgaycttgttgttgttgtttcgtatttttaatga

SEQ ID NO: 1121 - DNA, 61 bp, Homo Sapiens
aaattgctgctttcactgcttcattaccgtrtttctttcctctgctactttgtgcattttg

SEQ ID NO: 1122 - DNA, 61 bp, Homo Sapiens
tggactgtgatgaatacgagctgactttaaycacagcatggtcatatgcgtaagttatgca

SEQ ID NO: 1123 - DNA, 61 bp, Homo Sapiens
tcttagtgatagacatccaggctgcctctcrcttgttgttaccacaaaggaggctgcaaag

SEQ ID NO: 1124 - DNA, 61 bp, Homo Sapiens
ttattgtcaaggggagaagataggtgtcctycatgtaatcataccaataaacacagcatta

SEQ ID NO: 1125 - DNA, 61 bp, Homo Sapiens
tatctgcctccaaggtacagggagactgtawgctctgggtgacagttatttgagtgtgata

SEQ ID NO: 1126 - DNA, 61 bp, Homo Sapiens
atttgatgtcatttggaagaaggattccagyggaaacaaaaccatatatgagaggaggact

SEQ ID NO: 1127 - DNA, 61 bp, Homo Sapiens
tccagggcatttggtagacattatttaatcytcactgtgctcctgaggaacatgaggaatg

SEQ ID NO: 1128 - DNA, 61 bp, Homo Sapiens
tattctctcaccttgctcagtcacaaaatayagtctatcctgcaaagggtgtggccctggg

SEQ ID NO: 1129 - DNA, 61 bp, Homo Sapiens
gttacaggccttgtgggcaggaaggaatgtrgtatagactctgggcaggcatgtgtacctc

SEQ ID NO: 1130 - DNA, 61 bp, Homo Sapiens
tcaaagcataatcttcagactctatcatttsggaagtttgttatcatacagatgtttagac

SEQ ID NO: 1131 - DNA, 61 bp, Homo Sapiens
gaaatgtataaattaattcacatttgaagarataaaccaactgctcggggcacttccatta

SEQ ID NO: 1132 - DNA, 61 bp, Homo Sapiens
aggaaggagaataactggcaacccattttartctctaaggctgagatattacatttcattt

SEQ ID NO: 1133 - DNA, 61 bp, Homo Sapiens
tagcttaaacatgccctatgttagcacagcygtatataattttgaaaggtcagcatctcta

SEQ ID NO: 1134 - DNA, 61 bp, Homo Sapiens
agccaccatgcccagccataaccttctcatrtagtggagttgtcttattgataggggagga

SEQ ID NO: 1135 - DNA, 61 bp, Homo Sapiens
tcacttcaaacccaattttgacatggatacrtagatcgatgcaaatgtatcaattatctgc

SEQ ID NO: 1136 - DNA, 61 bp, Homo Sapiens
aaaccaatttgtcggatagtgagatgaaacrctggctatgagttccactggttttaccttc

SEQ ID NO: 1137 - DNA, 61 bp, Homo Sapiens
atctgcataatggaaacaaatgttacatctsaaagctaaatgaaaaaaatgtataattatt

SEQ ID NO: 1138 - DNA, 61 bp, Homo Sapiens
tagcctttgcttctgtccttttttcaccttygattctgttctccaaaaccatatacacctt

SEQ ID NO: 1139 - DNA, 61 bp, Homo Sapiens
gcatacctaaaagctgaacagccattctccygtatcctttacgtgacagcaaagacatgga

SEQ ID NO: 1140 - DNA, 61 bp, Homo Sapiens
aatccagtgagaatgaaggggaaaaagtaarcgttcatcttcttcaaaatccagtgtcatc

SEQ ID NO: 1141 - DNA, 61 bp, Homo Sapiens
gggcttgtatcaatttagatttgtttccacygctagtaacagagattagcaatagcaaggg

SEQ ID NO: 1142 - DNA, 61 bp, Homo Sapiens
tctgctgctcttgtaagctagcctgatatgytttgccatgagacatcttaacatctttact

SEQ ID NO: 1143 - DNA, 61 bp, Homo Sapiens
gagctcagagacatctgggcaggaacacaarttagcctccaggagcaggcggagggggcaa

SEQ ID NO: 1144 - DNA, 61 bp, Homo Sapiens
ggggtgtgctggaacccacccacaagacagrtatttgtgcctcttcccagccccatgttcg

SEQ ID NO: 1145 - DNA, 61 bp, Homo Sapiens
acagaggaggagtactctcagcaagagaaasagcccacgtgcaggtccagaagtgaggaga

SEQ ID NO: 1146 - DNA, 61 bp, Homo Sapiens
tactatagcaggtggcaagcctcagaaaatygttccctggagaggagggggtgcaggtgga

SEQ ID NO: 1147 - DNA, 61 bp, Homo Sapiens
ctagctattaaatgcaagtaataataaggtracaacattctctaccatgtctgagattaaa

SEQ ID NO: 1148 - DNA, 61 bp, Homo Sapiens
ctctctgggcctcagttcccatcatgttagrattgtctgaggattaaatgaaactgtcact

SEQ ID NO: 1149 - DNA, 61 bp, Homo Sapiens
atttcatcagtctgtccctggagttgctgtstttgtcagcttagcaggactattaatatca

SEQ ID NO: 1150 - DNA, 61 bp, Homo Sapiens
ttcaatgggatattcgtggcatttagcatcrtgcagatactagcatggagatgaagcagta

SEQ ID NO: 1151 - DNA, 61 bp, Homo Sapiens
gttgtgtgcccagtgccaggcaaatgctgtrgagggctccaaaggaagtgtgagatgggat

SEQ ID NO: 1152 - DNA, 61 bp, Homo Sapiens
cctgccccatccccaaaactaccacctaccrtctatgtgactagacaagaaacattctcta

SEQ ID NO: 1153 - DNA, 61 bp, Homo Sapiens
atggcagaggttattacgtcaacggcaaagrttattgctgctgctcctacctctcctactg

SEQ ID NO: 1154 - DNA, 61 bp, Homo Sapiens
cccctggggccttcagcagctgcattcttgrcccagcagaggacttgcctgatctccagga

SEQ ID NO: 1155 - DNA, 61 bp, Homo Sapiens
ccgaagccccctccctgtgtggtgtttgacrcagaggctgacagggcagggaagtggggtt

SEQ ID NO: 1156 - DNA, 61 bp, Homo Sapiens
tgtgggataggactgaattattaagcatgayattgtctgatgacccaaactgcccatgtca

SEQ ID NO: 1157 - DNA, 61 bp, Homo Sapiens
agctattgtgagaattgcctgagtagctcayacagcgggtatccagttagccaccgtaggt

SEQ ID NO: 1158 - DNA, 61 bp, Homo Sapiens
tggagcaagaagctgatcccaggataccttkcttgagaagagtggcaggagctgcgatatt

SEQ ID NO: 1159 - DNA, 61 bp, Homo Sapiens
ataacagcacatagacatcacacacctggtrtctccgtgaatgcagtatttctcccatcaa

SEQ ID NO: 1160 - DNA, 61 bp, Homo Sapiens
aattttcaaaagtgggtatatgtttccttgyttccctctgcattcctaatgtttcttctgt

SEQ ID NO: 1161 - DNA, 61 bp, Homo Sapiens
ttctgtttacatgttctcaaagaaccagctrttggccttattgatttgactatctccgttg

SEQ ID NO: 1162 - DNA, 61 bp, Homo Sapiens
tagttgtggctgctccaaagcctgtttttcragccagaaagcacgttttgtcttggagttt

SEQ ID NO: 1163 - DNA, 61 bp, Homo Sapiens
acagtgtctgcagcatagcaggcattcaatrtactcaatattctccaaatgatagtataca

SEQ ID NO: 1164 - DNA, 61 bp, Homo Sapiens
ccgggtcactgtgtgtgctgggcaagcttcsgtgttttcacctgtacaatgggcaccgcac

SEQ ID NO: 1165 - DNA, 61 bp, Homo Sapiens
ttagtattcaaaagaattttgatgtcctacrccagataaccctaaatttctgctatttgtc

SEQ ID NO: 1166 - DNA, 61 bp, Homo Sapiens
tccaaaatctgaaacttgaagcactcacatkacattcaaaggaaatgttcattggagcact

SEQ ID NO: 1167 - DNA, 61 bp, Homo Sapiens
cagcactgactttcctggtaacagtccgtgmcacacacatggagtacttgcagccaaggaa

SEQ ID NO: 1168 - DNA, 61 bp, Homo Sapiens
attatacaaatatttatcaaatgctgaccasgtgcaagacattacaggaccacaaagatga

SEQ ID NO: 1169 - DNA, 61 bp, Homo Sapiens
atatggcatgtcagcaggatgaccatacagyatggcttgtctgggacagtcccagttatac

SEQ ID NO: 1170 - DNA, 61 bp, Homo Sapiens
ccccgggaaagcttctggaacaacactttasgggctactgacaggctgctctgcttctcac

SEQ ID NO: 1171 - DNA, 61 bp, Homo Sapiens
tgacaaaattaaagcataattaacataagarcggatacattcattaaacatgtatcaggtg

SEQ ID NO: 1172 - DNA, 61 bp, Homo Sapiens
catgaccctcagtcctttcagctggtgacaytcaatgttgtttgattttgtgacacccacc

SEQ ID NO: 1173 - DNA, 61 bp, Homo Sapiens
tacagcgaatgcatttgttgggattgacttyaataatgaggctggttttgtttaaaaaatt

SEQ ID NO: 1174 - DNA, 61 bp, Homo Sapiens
aagaacctgaaataaatcaactgcattcatygtaagaataccacctctgaggaaaaaaaat

SEQ ID NO: 1175 - DNA, 61 bp, Homo Sapiens
agtggcgagatctcagctcactgcagtgttygtctcttgggtgcaagtgcttcccctgcct

SEQ ID NO: 1176 - DNA, 61 bp, Homo Sapiens
taaccttgtactctcttctatcatacgacartccacaccaccctacccctcctttgcgatt

SEQ ID NO: 1177 - DNA, 61 bp, Homo Sapiens
tcggcttatggaaaataattatccctttccsttatgagaccagcccctgagccgactaggg

SEQ ID NO: 1178 - DNA, 61 bp, Homo Sapiens
tgaaaaggaaaaaaagaggatgcacatcgtraatatgtatcgtcttggtggagttcaaatt

SEQ ID NO: 1179 - DNA, 61 bp, Homo Sapiens
tgcctgggctggttgcgaactcctggtggcytcaattgatctttgcacttcagcctcccaa

SEQ ID NO: 1180 - DNA, 61 bp, Homo Sapiens
cctgaaacaacctccctctgggacagaaatyggcttgggaactcaatcattcaccaaaagg

SEQ ID NO: 1181 - DNA, 61 bp, Homo Sapiens
cagccaacctgtggtgttttttctaaagagygttgctggcctcattggcaaggaacacata

SEQ ID NO: 1182 - DNA, 61 bp, Homo Sapiens
gcagtcacaagggaatctacaatttgctttyactgaccttattttcagagtacttaactaa

SEQ ID NO: 1183 - DNA, 61 bp, Homo Sapiens
taatgaaaagacttattcatatcctgatcaytaatattttccacacctggatttcttgatt

SEQ ID NO: 1184 - DNA, 61 bp, Homo Sapiens
ggaacttgtattagcagctttgaggatgacragaaacagaatttaagtgctacactagaat

SEQ ID NO: 1185 - DNA, 61 bp, Homo Sapiens
gaaggagtcaaagatgatttctgggtcatayttactggacaggtactattggtgtccataa

SEQ ID NO: 1186 - DNA, 61 bp, Homo Sapiens
tttcaaaaaatggtagctgttattatcataycactttcatggaatttcgttagttactcag

SEQ ID NO: 1187 - DNA, 61 bp, Homo Sapiens
tgcttgttgacctaagcaacatcaagccatragggttgcattccctcttcagttgccaagc

SEQ ID NO: 1188 - DNA, 61 bp, Homo Sapiens
agggcaaaatggaaaatgttctctctcttaygctttatcttttttgttccatcttaatagc

SEQ ID NO: 1189 - DNA, 61 bp, Homo Sapiens
gtgggacctttggagatttatggagtttagrgttacaagtatgatgtggccaccatactca

SEQ ID NO: 1190 - DNA, 61 bp, Homo Sapiens
caacttggtcacttgatccaatctttgatgwtcaccgtgggacctttggagatttatggag

SEQ ID NO: 1191 - DNA, 61 bp, Homo Sapiens
caaagttttacatttctaaacaagtgaaaamcaatagctgaaaaattgtaagatgatgcca

SEQ ID NO: 1192 - DNA, 61 bp, Homo Sapiens
gtatcatctccccatctccagatccttaatrtcatcacatctgtgaaatcgcttttaccac

SEQ ID NO: 1193 - DNA, 61 bp, Homo Sapiens
aagtgtttatgacagacagactcttggattyaggcttaggacaagcaaacctttcatatga

SEQ ID NO: 1194 - DNA, 61 bp, Homo Sapiens
cctgagttgcaaagcatatacaggctgaagyacaatgtcaagaaaacatgttaaagggtgg

SEQ ID NO: 1195 - DNA, 61 bp, Homo Sapiens
attctgacaggtatggaaatgcctcccattrgaaactgaagccctgggtcctttgaccgct

SEQ ID NO: 1196 - DNA, 61 bp, Homo Sapiens
gcaggacagggcagattatgtgaggttcagragtggacataatacacagagagatgctgca

SEQ ID NO: 1197 - DNA, 61 bp, Homo Sapiens
attttatattctcaaaatttagcaaaaagcstggtgtatagtggctgctgtatgatgtttg

SEQ ID NO: 1198 - DNA, 61 bp, Homo Sapiens
tggccgagcagatgtgcaggactgggctaargagcagacattcacccacctctgagcaaac

SEQ ID NO: 1199 - DNA, 61 bp, Homo Sapiens
tactcaacatgtaaaggcagagtaggaatgrgaaagactagggaaataagaagatcagaaa

SEQ ID NO: 1200 - DNA, 61 bp, Homo Sapiens
ttaagtcgcttccagtctgggctatttccaytggtagttttacgtttttctggtcacataa

SEQ ID NO: 1201 - DNA, 61 bp, Homo Sapiens
agttacctaagccttttgaagtttcctcacrtatcaaatggacataatagaacctatccac

SEQ ID NO: 1202 - DNA, 61 bp, Homo Sapiens
catagacatttaatgcttgtttcttgaatgytgctaaactgcatgtaaactcctcctgtgt

SEQ ID NO: 1203 - DNA, 61 bp, Homo Sapiens
tggaaaggatataaagtaaggtccagttcamttcttaggggatttgggagatcgtgtggac

SEQ ID NO: 1204 - DNA, 61 bp, Homo Sapiens
ctacactcacttttactcttccattaattgygtctcttttctatttacctaaccattgtta

SEQ ID NO: 1205 - DNA, 61 bp, Homo Sapiens
ggaagagatggccacatttgaatttcacaarcttcagtgcttccctgattgagtgcctcta

SEQ ID NO: 1206 - DNA, 61 bp, Homo Sapiens
ggcctaagtaaagccccaaagagtcttcctrcaaaggtaagcaacataagatataaatttg

SEQ ID NO: 1207 - DNA, 61 bp, Homo Sapiens
acattttatattttatttgctcttcaaattrgactgttagctgtgttctgccaggatacct

SEQ ID NO: 1208 - DNA, 61 bp, Homo Sapiens
gaggcatctctgttttaacaagtccagtagkaagctcttgaccaccctaccttacaaacct

SEQ ID NO: 1209 - DNA, 61 bp, Homo Sapiens
gatttgacatcatgttacatgacctatcacrgacatttgaagtacctactgacttcctctt

SEQ ID NO: 1210 - DNA, 61 bp, Homo Sapiens
cttgctgccatgtaagatgtatctttgctcyttcttcgccttttgccatgagtgtgaggcc

SEQ ID NO: 1211 - DNA, 61 bp, Homo Sapiens
tagcacaaaacaatgcaggttgacccagctwtgtcatttggtaaaatatctcccaggcaat

SEQ ID NO: 1212 - DNA, 61 bp, Homo Sapiens
acctctcagaggggagccacaggaaggttaragcagaaaaaggactggacttacttacatt

SEQ ID NO: 1213 - DNA, 61 bp, Homo Sapiens
agccttctcatgctctcttttacctaccacwtctgactgatagccaggccctgctatttat

SEQ ID NO: 1214 - DNA, 61 bp, Homo Sapiens
tccccacctccctctgcagatcttgttctcrgaggccattcccagacccacagcaagaggg

SEQ ID NO: 1215 - DNA, 61 bp, Homo Sapiens
agctctgtgatcactagccttggattaaatstggtgggttcagcccctgactgacttcagg

SEQ ID NO: 1216 - DNA, 61 bp, Homo Sapiens
tgaagtccatcccgatctgaaggttcacccrtcactaagagacaaatggtgcttctgttaa

SEQ ID NO: 1217 - DNA, 61 bp, Homo Sapiens
tgtaagatacaaatcttcaggacctagtgtrtgcacatgttggctcttatataagatggca

SEQ ID NO: 1218 - DNA, 61 bp, Homo Sapiens
gcaggcgggaacactgtgggccctcaagttsaatggaaatataaagggcagatctattgag

SEQ ID NO: 1219 - DNA, 61 bp, Homo Sapiens
gaacggaagagggagagaggccagccctatktaccagctgctcccacatgagtgggacttg

SEQ ID NO: 1220 - DNA, 61 bp, Homo Sapiens
ggacgtagatcccaaatcattatagaaatcsctaacattaatccaacttacaagggatgtg

SEQ ID NO: 1221 - DNA, 61 bp, Homo Sapiens
agcacaccacacgtccctggggaaagaagcygatttgccaccctccacaaaacaggggggt

SEQ ID NO: 1222 - DNA, 61 bp, Homo Sapiens
tcccattttacatgacagagggagacactcrgaggtgaagtaatttgccaaaggtcaggat

SEQ ID NO: 1223 - DNA, 61 bp, Homo Sapiens
tagttggtctgtattatccttggatgacaayggtgtcatgtgacactatctagggtactgt

SEQ ID NO: 1224 - DNA, 61 bp, Homo Sapiens
ctagcctacaataaggtttttcagccagaaragcagttgtatttacttaagagaacttata

SEQ ID NO: 1225 - DNA, 61 bp, Homo Sapiens
gtcttaggactcagctttgagaaccaaggayctagcaaactcagatgaaaaatttataatt

SEQ ID NO: 1226 - DNA, 61 bp, Homo Sapiens
tcagcagcttttccctttaggtaatattctrattgtactcagtcacatgtgaggtgtgtcc

SEQ ID NO: 1227 - DNA, 61 bp, Homo Sapiens
actgagctctgactatatgtcattagccctygaagcctttttagagtaatgcaatgtatag

SEQ ID NO: 1228 - DNA, 58 bp, Homo Sapiens
gttactgtgtgagacgaaagacagttcactrttcatcactggaaatactgtacgtgct

SEQ ID NO: 1229 - DNA, 61 bp, Homo Sapiens
tcttactgtttgagtcagaagcccaaggtakcttgctatttttcacactggcacactggag

SEQ ID NO: 1230 - DNA, 61 bp, Homo Sapiens
catctgttatcacctaatcccagaagcgacrtaccatcccttttgctttattctgttggtc

SEQ ID NO: 1231 - DNA, 61 bp, Homo Sapiens
gatcacatattgtgattccacttacatgaaraacctagataagcaaatttatagaaccaga

SEQ ID NO: 1232 - DNA, 61 bp, Homo Sapiens
tggaactttgctcatgtctgcgtcagtggarcctagacctggaatctcaattgtgtgattt

SEQ ID NO: 1233 - DNA, 61 bp, Homo Sapiens
tatgaagaaaacctgaaaattctgccaaagrtatccaaacgcgcaccctctgtcctttgca

SEQ ID NO: 1234 - DNA, 61 bp, Homo Sapiens
ttatatactaggaagagctcatttccagctytcatgaaaaaaataaacatttaggagcatt

SEQ ID NO: 1235 - DNA, 61 bp, Homo Sapiens
tcaccctgtcctcagaggaccttcctctggkcttatgtgaaaagagagctagagagagaaa

SEQ ID NO: 1236 - DNA, 61 bp, Homo Sapiens
gcccagcgaatccggatctcctgtgtatgtsaaccaagtcaaagtgcgagtctccgacgcc

SEQ ID NO: 1237 - DNA, 61 bp, Homo Sapiens
caatttgcctccaaactctaaaacaatgaaytaggacacatttttcccattgtatgcagtt

SEQ ID NO: 1238 - DNA, 61 bp, Homo Sapiens
aagactgggtttctgtgatgtggctgacaargagaggacctattctcatgtggaattaaag

SEQ ID NO: 1239 - DNA, 61 bp, Homo Sapiens
cccactggcgcgccccctccttccccaatgyccttgctgagtggcaagacttttcctaggc

SEQ ID NO: 1240 - DNA, 61 bp, Homo Sapiens
gatcttgtacacagaattttgtaagcactcytatgaaaaggtattatctaacgtgtggctg

SEQ ID NO: 1241 - DNA, 61 bp, Homo Sapiens
ttcagcttatttggataaataccaaggagcrtaattgctggattgcatcgtgagagtaagg

SEQ ID NO: 1242 - DNA, 61 bp, Homo Sapiens
tagctcactaaggccactgtatcccctcctratggtagtcttctaaaatggagaatgcttg

SEQ ID NO: 1243 - DNA, 61 bp, Homo Sapiens
gcttatgcataaatgagccatagttaaatcrctcacgtattttctgttgttatagtcatct

SEQ ID NO: 1244 - DNA, 61 bp, Homo Sapiens
aggtatgaacttgatagttcaatgtccgttktaagttgtcagttagtttgactccactata

SEQ ID NO: 1245 - DNA, 61 bp, Homo Sapiens
gtgggaggtggtctcacagcaggtctttacragcctcccgtctttctgtgttctgggagaa

SEQ ID NO: 1246 - DNA, 61 bp, Homo Sapiens
acggttttgtagcttgtgttccacgtgtccyacttctggtcctcaaattcagcttgcctgg

SEQ ID NO: 1247 - DNA, 61 bp, Homo Sapiens
gagtacttatatttctttttcaatgttgtakctagtccatctcatcattttttaaacctaa

SEQ ID NO: 1248 - DNA, 61 bp, Homo Sapiens
tttaacaattaactagattatcaggaaaaawtacagtggaagaacattctcatttaaacac

SEQ ID NO: 1249 - DNA, 61 bp, Homo Sapiens
ttgggtgtgtaaaggggaaagatttagcttyggacaatgatgatggcgctgtgcagtggac

SEQ ID NO: 1250 - DNA, 61 bp, Homo Sapiens
acagcttcaacaaagaacatacagtgaaaaygacttccaaggttagatcataaaaatacca

SEQ ID NO: 1251 - DNA, 61 bp, Homo Sapiens
aaacgaaaaaaaaattctatttgtaaaactytgtgaagagcatgggtatactaggcattct

SEQ ID NO: 1252 - DNA, 61 bp, Homo Sapiens
ctgcaccttgctgtcctgggcactggtgagrgcaactgagtttttgcttgttgaggctcct

SEQ ID NO: 1253 - DNA, 61 bp, Homo Sapiens
aacaattacaatattgatatcaaagaacaayggtcacagatcaccgaaacagacataccaa

SEQ ID NO: 1254 - DNA, 61 bp, Homo Sapiens
aaggaaagtttgctaaatatgtattttgaaygtctgtataaatggaaactgaatctctcac

SEQ ID NO: 1255 - DNA, 61 bp, Homo Sapiens
acagttgtcactgatatatgactttgagaayatgaactgctgtataaatgttaaatgttcc

SEQ ID NO: 1256 - DNA, 61 bp, Homo Sapiens
aggacagcatggatttatatccctagtgtcrttcacaactctaatttgttcccagtgtgaa

SEQ ID NO: 1257 - DNA, 61 bp, Homo Sapiens
tggcacttatttcaaagtatgattagtttasagatgtttagaatatgcacatttacagttt

SEQ ID NO: 1258 - DNA, 61 bp, Homo Sapiens
ctattctgaaggattctgccatgttatgacscaatcacctcccaaaggtcctcaatatcac

SEQ ID NO: 1259 - DNA, 61 bp, Homo Sapiens
aagcctagtgtttagcaggggagataagcgrtgatatcaaaaggagagggggctgcacaag

SEQ ID NO: 1260 - DNA, 61 bp, Homo Sapiens
gaaccaaagaaattgtgatgatctctgagcwgtatttggacaccaggagaggttgctctga

SEQ ID NO: 1261 - DNA, 61 bp, Homo Sapiens
cttgaagtcagggcctctatcacactcacarttgtttacggtgctgaacagtgtcttcggt

SEQ ID NO: 1262 - DNA, 61 bp, Homo Sapiens
aatgcattgtctacatcggacagaaaaggamccagaagcatcacagactcttgcaacacca

SEQ ID NO: 1263 - DNA, 61 bp, Homo Sapiens
ttaaaatattccattttaacttattaggcarttatggcttcttatatatgctataagcaaa

SEQ ID NO: 1264 - DNA, 61 bp, Homo Sapiens
cattattaagcaagaggggaaaaatctacckttatgtgaggttgggttgtcagatattttt

SEQ ID NO: 1265 - DNA, 61 bp, Homo Sapiens
cacagcatcttttcacattagatgaaattgrgtatgagatgggaaaatgagcaccacacga

SEQ ID NO: 1266 - DNA, 61 bp, Homo Sapiens
catagtcaggaatatgtgacagacacctctygtactttaagtcaagatattatagctatct

SEQ ID NO: 1267 - DNA, 61 bp, Homo Sapiens
aatgaatgaattaagggcgcagcactgagaygttaagttaagaagtatggttcaacagcct

SEQ ID NO: 1268 - DNA, 61 bp, Homo Sapiens
gtccttgagtacataggaaagtgagggaaaygaataaaactgaggtttatgtggcaattgg

SEQ ID NO: 1269 - DNA, 61 bp, Homo Sapiens
atcaatgtgcaatgtctgttttttttagcastttcagggacacagagacttggagtaattc

SEQ ID NO: 1270 - DNA, 61 bp, Homo Sapiens
ttttatgcactagacaatggatctgcaactwtggactaaggtcattcaatgtacccaaact

SEQ ID NO: 1271 - DNA, 61 bp, Homo Sapiens
caatgtttggaggtcaggacaatgaggatgwaactgcaagaaagataagagtagtcacatg

SEQ ID NO: 1272 - DNA, 61 bp, Homo Sapiens
atgaccttggtttagcggtcagcaggtagcraggaaagtgatctcaagggccagaaagata

SEQ ID NO: 1273 - DNA, 61 bp, Homo Sapiens
gtgtctttgttatcaacacgttattaagaawgggcaagatgtccttatatactagaagctt

SEQ ID NO: 1274 - DNA, 61 bp, Homo Sapiens
tttatacttgcttcatgtcttatgacaaccrgatccaaggccatgggagtatttcaggaag

SEQ ID NO: 1275 - DNA, 61 bp, Homo Sapiens
aaagaaatgaagtcctctccattttaacttwgcttccagcctggccaagagaaaagacttt

SEQ ID NO: 1276 - DNA, 61 bp, Homo Sapiens
tggtttagatttgagaaactcagcaaatackggagtgactgctatgtgcaaagaacaaggt

SEQ ID NO: 1277 - DNA, 61 bp, Homo Sapiens
tcctgcctgcccctggcctggccagctcctsattggttcttcctgtttttccttctctcca

SEQ ID NO: 1278 - DNA, 61 bp, Homo Sapiens
cagcttttttggggatataatccacatgccrtataactcatctatctaaagcatgtaattc

SEQ ID NO: 1279 - DNA, 61 bp, Homo Sapiens
aacaaaaagataacagccaaataactaaagkatgcttttgccttggtgatggggatttagg

SEQ ID NO: 1280 - DNA, 61 bp, Homo Sapiens
gtgattagcattactaccctctatgcgtaamtccatgtaaattcctcattgtgttcactga

SEQ ID NO: 1281 - DNA, 61 bp, Homo Sapiens
ttatggaaggaggcagttacaaggagaaatytggagaatcgtctgtgttttaatttaggac

SEQ ID NO: 1282 - DNA, 61 bp, Homo Sapiens
ctttcctaaaccagtctcaggaaggtccacrctctatttccctttgcaaaagcatttaagt

SEQ ID NO: 1283 - DNA, 61 bp, Homo Sapiens
gtatccaatgttgcagtttataatgcacctkgataatttttttcctataaattgataattg

SEQ ID NO: 1284 - DNA, 61 bp, Homo Sapiens
tatggaaaattactcaggttcatcttacacrtttcctgctccaggccaggaattgcctact

SEQ ID NO: 1285 - DNA, 61 bp, Homo Sapiens
cttctttatctttcttcaaaattctctgcakctaacattacattataatgatcatttagtc

SEQ ID NO: 1286 - DNA, 61 bp, Homo Sapiens
gcccactgcttcccaccaatgagttaagtartttttcttgcccatttctgcaaatttgtgt

SEQ ID NO: 1287 - DNA, 61 bp, Homo Sapiens
acagcaacagtaattcaccttcaaaatcccyaaaacgtggttgaataaacaaatgaagaac

SEQ ID NO: 1288 - DNA, 61 bp, Homo Sapiens
tagcagctgtgcggaataatgtgctttgacrttcaataaaactgttgaatctatattccaa

SEQ ID NO: 1289 - DNA, 61 bp, Homo Sapiens
gtacatgcattacagtattgagtcacaacarggtgctattattcatgtattatcagtggct

SEQ ID NO: 1290 - DNA, 61 bp, Homo Sapiens
caaaagcaggcacaaggaccctctgcgttaktctgtgcacctgctctgggggttttctgcc

SEQ ID NO: 1291 - DNA, 61 bp, Homo Sapiens
cttaatgtatatgaatatgtttgtgtacctyagtcattctgtatgttaaaatgtttgaatc

SEQ ID NO: 1292 - DNA, 61 bp, Homo Sapiens
ggtgagcacttacttactgcttctttgccastcttgctgaatttggatttatactttttgt

SEQ ID NO: 1293 - DNA, 61 bp, Homo Sapiens
atacaagtgctaaaaggaaagggcaatgtamaataagtgcatgtagttagagtatgtgatc

SEQ ID NO: 1294 - DNA, 61 bp, Homo Sapiens
tggacatagagagtggaataatagatcttgsatatgtggaagggtggaagattgggaggag

SEQ ID NO: 1295 - DNA, 61 bp, Homo Sapiens
tgtgcttttcttctggtgccctgttttggcrtttgtgtcatagttatactgatgcctaatt

SEQ ID NO: 1296 - DNA, 61 bp, Homo Sapiens
ttggcaccataagtagctgtgataatgccawgtttacatgaggatctggagaaacaagacc

SEQ ID NO: 1297 - DNA, 61 bp, Homo Sapiens
ctgacaccacatggccttgactggtattacrctaacgtgatgatgcgtgagctcttcagac

SEQ ID NO: 1298 - DNA, 61 bp, Homo Sapiens
tctctgggtgttctttgaatatcctgtgaaygcctctgactttatgcccccaccttgttta

SEQ ID NO: 1299 - DNA, 61 bp, Homo Sapiens
aaacaaagaaaagacttccaagccttcaatrttctaagttgccatggcagcagcaccatca

SEQ ID NO: 1300 - DNA, 61 bp, Homo Sapiens
cctaggcaataccattcaggacatagggatmgggaaagatttcatgatgaagatgccaaaa

SEQ ID NO: 1301 - DNA, 61 bp, Homo Sapiens
attctgttaatttgggattcttacttccaamtgaatatgaagatttgtattggatttcttt

SEQ ID NO: 1302 - DNA, 61 bp, Homo Sapiens
tatgtgtatctgtttctaaatatgctttgtyggtttcctttttcttttttaaaaatttcat

SEQ ID NO: 1303 - DNA, 61 bp, Homo Sapiens
gcacaaggaagatatgtataagaaggaaacrtagcaaaggcaaaatattctagttcacttc

SEQ ID NO: 1304 - DNA, 61 bp, Homo Sapiens
ttttgcatcacaaaaacacaagtaggttctytgtaatatttgtagaataaatgaataatta

SEQ ID NO: 1305 - DNA, 61 bp, Homo Sapiens
ctatatgtgagagcatgtcttcaggtgtgamttcaaaatctgtgatgatttacaattatac

SEQ ID NO: 1306 - DNA, 61 bp, Homo Sapiens
gctgttctcatgaccatgagtgaattcccastagatctggttgtttaaaagtgtgtagcat

SEQ ID NO: 1307 - DNA, 61 bp, Homo Sapiens
cggctgtgggaaaagtagagtatgccagaawgtaaaatcacaataatgagccatagtctac

SEQ ID NO: 1308 - DNA, 61 bp, Homo Sapiens
catactggtgaagggaggaaaaagatttagkgttcaggcagctaaaggaatacaccagaaa

SEQ ID NO: 1309 - DNA, 61 bp, Homo Sapiens
tcttactgggagttgaagaggttgatcatgytttcttgctgcccaacactttttaagcaac

SEQ ID NO: 1310 - DNA, 61 bp, Homo Sapiens
gacattctgttctctgagggcatggagtccraagtcctaggggtagcatcctgtgcccagc

SEQ ID NO: 1311 - DNA, 61 bp, Homo Sapiens
agagacataagaggtggggaagataattcayaggtcttaattgtgcataattatgcatatt

SEQ ID NO: 1312 - DNA, 61 bp, Homo Sapiens
aaataaagactgaagctcagtgcagcaagayacatccttagttagttatatgttcgcacct

SEQ ID NO: 1313 - DNA, 61 bp, Homo Sapiens
ggaaaacagtggagcagaaacacagaaaaaytcagtactccagacccaaccttaagcacaa

SEQ ID NO: 1314 - DNA, 61 bp, Homo Sapiens
tctgacatttaaatataatgcaagccacaawtgtgttctgcaaatgtcaagttaaagcttt

SEQ ID NO: 1315 - DNA, 61 bp, Homo Sapiens
ttcttattattcaaacgtgaaattattcaarttattcaacgtgaaattcttttcatatgat

SEQ ID NO: 1316 - DNA, 61 bp, Homo Sapiens
cagccctagcaaccaccattctacctgtgtytctgcgaatttgacgactctaggtatctcg

SEQ ID NO: 1317 - DNA, 61 bp, Homo Sapiens
tctttaataccattattgtatgtatcaatcygaaagacacataaacacatggtgcttaatg

SEQ ID NO: 1318 - DNA, 61 bp, Homo Sapiens
aaaaagaggtaagaggcaaaagtcaagtgtrttttttgagacggagtctcgctctgtcacc

SEQ ID NO: 1319 - DNA, 61 bp, Homo Sapiens
ctaggcaaattgcatctagcaaacagttgtstcatttaatcttttgatgtcttaaagcatt

SEQ ID NO: 1320 - DNA, 61 bp, Homo Sapiens
gaagcaatgaatagcaataaggatgaataaracagttatggaccggaaacagtgaacagtt

SEQ ID NO: 1321 - DNA, 61 bp, Homo Sapiens
tatccatgttaggaatgagagtggtgacatyactatagactctacagacattaaaaggata

SEQ ID NO: 1322 - DNA, 61 bp, Homo Sapiens
gattaaagttccctaacttaaataattactstaaactctttctagactagactttaaaatg

SEQ ID NO: 1323 - DNA, 61 bp, Homo Sapiens
ttgtgaaatttattttttaaaaagagtatcraatgtttaatcacagaataagtggttgtta

SEQ ID NO: 1324 - DNA, 61 bp, Homo Sapiens
ttttggctactgtagccttgtagtgtaattygaagtgaggtagtgtgatccctccagcttt

SEQ ID NO: 1325 - DNA, 61 bp, Homo Sapiens
cccccctacttatcccaaaaggctgatatgkttcctctgaggcttgagcttggccattctc

SEQ ID NO: 1326 - DNA, 61 bp, Homo Sapiens
cgtttacaatgatgaaaacattatgaaaacrgtgattggtggttactcaacattgtgaata

SEQ ID NO: 1327 - DNA, 61 bp, Homo Sapiens
aaggcatgtaaagatgctgtcttttaacaaytgaaggcattgaaaaattaacatttcagaa

SEQ ID NO: 1328 - DNA, 61 bp, Homo Sapiens
atttgtaacttggcctatcagtttgagaccyttgttctagacactttgtatactgtctcaa

SEQ ID NO: 1329 - DNA, 61 bp, Homo Sapiens
ccagaacagcaagcaacctttggatatttcratattagctgaaatggaaaagatcactggc

SEQ ID NO: 1330 - DNA, 61 bp, Homo Sapiens
gggaaagaagaaaagattccgtattttttaytctggcttccttgagcacagctttcttctc

SEQ ID NO: 1331 - DNA, 61 bp, Homo Sapiens
aatcattaatattgtacagtgttagagcatrgtagctttgatcgtcatttaaatacaactg

SEQ ID NO: 1332 - DNA, 61 bp, Homo Sapiens
aactttttttttcttgtaggtttgcacatastaactttaaaatacatacaatcccaatcca

SEQ ID NO: 1333 - DNA, 61 bp, Homo Sapiens
caggaaaaggtcagtcttagtcaaatctagycatgaaaaggcagtctcatgcagttgtatg

SEQ ID NO: 1334 - DNA, 61 bp, Homo Sapiens
tggagctgggtcttgacactgagctcttgcrttcctcgcctccctttctcttggcatttcc

SEQ ID NO: 1335 - DNA, 61 bp, Homo Sapiens
tcagaacttcctgcctgcccctaaacaaggraaccaaatcaaagccctgtgtacttgctca

SEQ ID NO: 1336 - DNA, 61 bp, Homo Sapiens
atatcaccgttattaatagcttctattgaaygtgttcgctctgccaagtattatgctgagt

SEQ ID NO: 1337 - DNA, 61 bp, Homo Sapiens
ccaatatattctcaatctcaccaaaaagcaycaccataataagcattatgaagagtctaaa

SEQ ID NO: 1338 - DNA, 61 bp, Homo Sapiens
attgttgtacaattttatattttgcaaacawctcttacaattcttttaatttaatccgtgt

SEQ ID NO: 1339 - DNA, 61 bp, Homo Sapiens
agggtgatattgcaaaagtattatcaaagaragcatatgacagggggagtggagatttgga

SEQ ID NO: 1340 - DNA, 61 bp, Homo Sapiens
aatatacagatattctctctattgtgctgayttcactattttatttagtgaacatataaaa

SEQ ID NO: 1341 - DNA, 61 bp, Homo Sapiens
atagttggtgtcttcttactttgttgtcacrtcgtggtgagggttctctctggagcctctt

SEQ ID NO: 1342 - DNA, 61 bp, Homo Sapiens
caagaggacaaaactgcagtgggaagaaaaygtcctttagggtcagacaaaattaggtttg

SEQ ID NO: 1343 - DNA, 61 bp, Homo Sapiens
ttgataaataaaaacttctggtttaagtagrgaagaagatgttttaaggtcggttcttgga

SEQ ID NO: 1344 - DNA, 61 bp, Homo Sapiens
cgatacctgtggtccgggatgtatcaagacstgtgacaactggaatgaaattggtccatgc

SEQ ID NO: 1345 - DNA, 61 bp, Homo Sapiens
aattatatttttacattctttatgtttcccyggcattcataaagtagcagggattgcatta

SEQ ID NO: 1346 - DNA, 61 bp, Homo Sapiens
ctccaatgccaccagcctttgcttacctggyattctgtaaattctgaacaactggctacct

SEQ ID NO: 1347 - DNA, 61 bp, Homo Sapiens
acctcatcaggctcctcacacagccttgcakgacagcttatcctccattccttggcagcag

SEQ ID NO: 1348 - DNA, 61 bp, Homo Sapiens
aaggaaatccaaaggacattcttgtacagawctttttatggaactgattttcatctcttga

SEQ ID NO: 1349 - DNA, 61 bp, Homo Sapiens
aattagccaatagaaggcatggttgataaawactttcatctcatgagggttattgaaaggc

SEQ ID NO: 1350 - DNA, 61 bp, Homo Sapiens
aggagcactgttcaaagaataagattctcaytctattgccaggttataaagtcctatgttg

SEQ ID NO: 1351 - DNA, 61 bp, Homo Sapiens
ataccatctaccactaacatctacaaatgtstgactaaatttggatggccagatacttttg

SEQ ID NO: 1352 - DNA, 61 bp, Homo Sapiens
ggattatgggcagtagctctctgtgcgacartgtaatcagtgcaatggtgaagtggtggca

SEQ ID NO: 1353 - DNA, 61 bp, Homo Sapiens
cctatgtgttttgcacactactaaaatggtrctttgctataacttcccaaatacaaaacat

SEQ ID NO: 1354 - DNA, 61 bp, Homo Sapiens
agggccggaatgcattctcttccatttctasagaatccttgcttattctccacaattttgg

SEQ ID NO: 1355 - DNA, 61 bp, Homo Sapiens
taacctcaggagtgatgacaaccaaaacctsttgttaatatgtcttctaaaatgtgaaact

SEQ ID NO: 1356 - DNA, 61 bp, Homo Sapiens
ccaacactcagacacccctgaaagacaatgwtattatgtttaatccagagatgaggacact

SEQ ID NO: 1357 - DNA, 61 bp, Homo Sapiens
ctcaaagccctgtgctggcttcctacctcastcaaattaaaagccaaagacttctcaaggg

SEQ ID NO: 1358 - DNA, 61 bp, Homo Sapiens
ctttccagagaagagtacattttaaatagcyacgtccccttcatgacattgctagaacttt

SEQ ID NO: 1359 - DNA, 61 bp, Homo Sapiens
tcaaactactgaactgcggtcttggacaccrtctttctggaggatcatttggcatcatgga

SEQ ID NO: 1360 - DNA, 61 bp, Homo Sapiens
attatcataacctttgattcagtaattccartcctaagaatcaatggtaggaaaacattca

SEQ ID NO: 1361 - DNA, 61 bp, Homo Sapiens
agactgctgcatgcacactgtcctttctacrgatgtctgcaaatgatatcaaatgctaagt

SEQ ID NO: 1362 - DNA, 61 bp, Homo Sapiens
tgcagcagaaaagcaattattaaacttcacraatacactgattattaaagaacacaggccg

SEQ ID NO: 1363 - DNA, 61 bp, Homo Sapiens
tagccacactgttggatatagtagaggttgsttctttgccactgctgggtattatttcatg

SEQ ID NO: 1364 - DNA, 61 bp, Homo Sapiens
tcagctagctccttaaagttcctagaatgtyagaagagtaaaggttccttgaagatagata

SEQ ID NO: 1365 - DNA, 61 bp, Homo Sapiens
tatactgcatgaaaatgtggttgaaatatcyttttattccaaaaacaactactgattatct

SEQ ID NO: 1366 - DNA, 61 bp, Homo Sapiens
cctaaggtcggtttcttcctctgtagaatgsggatgaaaatagaaatcacatcacccggtt

SEQ ID NO: 1367 - DNA, 61 bp, Homo Sapiens
ctataatacagttgaatctatacacgatatgraaaatagtacaaactattgccattgcagt

SEQ ID NO: 1368 - DNA, 61 bp, Homo Sapiens
gtatcatgaacttcttctctgacacataaaygtctggaaattactggagaaactcccccca

SEQ ID NO: 1369 - DNA, 61 bp, Homo Sapiens
cctgttttcactcatctcttcctttaacccrgattccaagaaagcttgacaactgtctaca

SEQ ID NO: 1370 - DNA, 61 bp, Homo Sapiens
ggcctgaaacagaagcagcaacaatgaggtrtgaactagagttggtgaaaccaaggcttac

SEQ ID NO: 1371 - DNA, 61 bp, Homo Sapiens
atctatcaatctatcatctatctagtctatmtacctacttatctctaatcacccaccaaaa

SEQ ID NO: 1372 - DNA, 61 bp, Homo Sapiens
tgggctgcttaataaccttcctaacattcgrcattatttctactttctagccagaacattc

SEQ ID NO: 1373 - DNA, 61 bp, Homo Sapiens
ccaggatattattatttcctgaattaccaaytgagtctgagctttttacttttaattccct

SEQ ID NO: 1374 - DNA, 61 bp, Homo Sapiens
gtagattttgctcacttttttgtgagttccscacaacctggtcttcccagatagcactttt

SEQ ID NO: 1375 - DNA, 61 bp, Homo Sapiens
gtggggcagagggcctgagtgattagattgytcctggcctcagaagctcatggagccctgg

SEQ ID NO: 1376 - DNA, 61 bp, Homo Sapiens
tcacagctttgcgcttcttggggaggttttrgagactgtgaggcagagctcccctggcagt

SEQ ID NO: 1377 - DNA, 61 bp, Homo Sapiens
aatagtccctagggtctggccatgtggtatycttgcttgtcagagtttaaagagacttgac

SEQ ID NO: 1378 - DNA, 61 bp, Homo Sapiens
cactatcttggtagagaagggcaaacaacartgagagccttggagctcagcatctaggagt

SEQ ID NO: 1379 - DNA, 61 bp, Homo Sapiens
ttccgtttcttaataagactagttatatttytgtgacagtgcaagccttttcacagagatc

SEQ ID NO: 1380 - DNA, 61 bp, Homo Sapiens
actttgtttataaaccattttctagatttarttttgtgtttttcactgtgttttctttgag

SEQ ID NO: 1381 - DNA, 61 bp, Homo Sapiens
tagaaatcagttaagaagatgcaacaaccargtaaatccctaataatgcaagaaaatgtca

SEQ ID NO: 1382 - DNA, 61 bp, Homo Sapiens
catctttgtcttttccttgatcctggaagargcgcatttaatctttggcaattgagtgtaa

SEQ ID NO: 1383 - DNA, 61 bp, Homo Sapiens
acgatttaaactggacgaaacaatttgcgcrctaccctggctggggactgatgcggaagat

SEQ ID NO: 1384 - DNA, 61 bp, Homo Sapiens
ttccatgctcagaattctaaaccagtcttgraatctcactgcatcactgcatatacctttt

SEQ ID NO: 1385 - DNA, 61 bp, Homo Sapiens
agaaaagacagcaagaaggccatttttcacrttggctgtaaggcgagatttgatcaagaac

SEQ ID NO: 1386 - DNA, 61 bp, Homo Sapiens
tacttctcatcctcttgagttttccacacaygaatttattgtctgtaaattactgctgaaa

SEQ ID NO: 1387 - DNA, 61 bp, Homo Sapiens
agaaataataactcaaatgtttaaatgaagkttcaatgctataccacataaaatccacctt

SEQ ID NO: 1388 - DNA, 61 bp, Homo Sapiens
ttgatggacaccatcaaacatttacttggaytattacatctgaaattattgaaatttgtgg

SEQ ID NO: 1389 - DNA, 61 bp, Homo Sapiens
agataactgaaatgcaagtgcatggaaaccrtaaaatggatgtgagcattttctaataata

SEQ ID NO: 1390 - DNA, 61 bp, Homo Sapiens
cgcagagtgctgtatttcctgttttgaagtwgaaagatactgagtagaaaaaaatgagtat

SEQ ID NO: 1391 - DNA, 61 bp, Homo Sapiens
gtgttttcaataagtagtgctaggagaactrgacagtcacatgcaaaagtatgaagctggg

SEQ ID NO: 1392 - DNA, 61 bp, Homo Sapiens
tgacacattcttacatccctggtccacactygtctgatccttgtgtagtaggatcaagcct

SEQ ID NO: 1393 - DNA, 61 bp, Homo Sapiens
tttaaaggaagatccagctaactatcccacrtagaccagcaaatgatgcatggatttaaaa

SEQ ID NO: 1394 - DNA, 61 bp, Homo Sapiens
tcaccccaaaaagataatctgacgttttagygtccacaaaagcttctctatttattgggtt

SEQ ID NO: 1395 - DNA, 61 bp, Homo Sapiens
ttttaaaaagtcctgtgttgactttaaagcrgctcagagacatcgcctaaggcaagactaa

SEQ ID NO: 1396 - DNA, 61 bp, Homo Sapiens
ggatatcacacaaagacaaaaaatccccacsaaagaggctcacaatagaagggacagtgac

SEQ ID NO: 1397 - DNA, 61 bp, Homo Sapiens
cttcaggaaagttctagaacgtatgcatcaygcacccactcatctcctacactcctattta

SEQ ID NO: 1398 - DNA, 61 bp, Homo Sapiens
ggtgggatgctgggcgctgccctgggaagakttctatttccaaatggaaggtgaaaataag

SEQ ID NO: 1399 - DNA, 61 bp, Homo Sapiens
gcacagcaggaagacagggcgctagggaccrgtttctacctttgcttgcctagagtaacca

SEQ ID NO: 1400 - DNA, 61 bp, Homo Sapiens
gtgtctgtgctacaggtttgctgttatggtygtttttaccaaagactggtgtttgattttg

SEQ ID NO: 1401 - DNA, 61 bp, Homo Sapiens
tcccaggtgtggcagccctttgaagggcagscgcgatctggagcagggaagggcatggagc

SEQ ID NO: 1402 - DNA, 61 bp, Homo Sapiens
aatgaggccttggctaagtggtgctaaaaarcaatttccatctaaacacctggttgataat

SEQ ID NO: 1403 - DNA, 61 bp, Homo Sapiens
cagtcagccatctgcatgggttagttacccrtgcagaaatcagtcagcctccaactcctcc

SEQ ID NO: 1404 - DNA, 61 bp, Homo Sapiens
tggcttctccgccaggaaaatgtgtgtcccrtaagcccagtggaacagtttccttgggaca

SEQ ID NO: 1405 - DNA, 61 bp, Homo Sapiens
ttcacttttgagacagtcacaaaccccatcytgttcaagaactcagtcttgttccctgcca

SEQ ID NO: 1406 - DNA, 61 bp, Homo Sapiens
cctgccatacccagaacagcagatagtaacrgggacccaagaaagatctgctgactaataa

SEQ ID NO: 1407 - DNA, 61 bp, Homo Sapiens
taaaaacacttaaaatataaacagtgaagaygaaactgagtaaaacccaaactccacccac

SEQ ID NO: 1408 - DNA, 61 bp, Homo Sapiens
gagaccagtgaggcccagaggcatgtccgcraggagagtgtgcgcagcccggctctgctgc

SEQ ID NO: 1409 - DNA, 61 bp, Homo Sapiens
ggttctaggcatggagaagagggtggagacyaattgaaacccctaccggaggagactttat

SEQ ID NO: 1410 - DNA, 61 bp, Homo Sapiens
aggaagtctaatggtgaaaatgatttaattmgcagaagcaaccaaaacaacacacttaaga

SEQ ID NO: 1411 - DNA, 61 bp, Homo Sapiens
gcaaggattctggaggagcttgttcacaagygtctgaaagggggccctcagctgttgatga

SEQ ID NO: 1412 - DNA, 61 bp, Homo Sapiens
acctcgttctggtcttctagaccacattctsgatgcaagagtcccaggacagtcaaagaat

SEQ ID NO: 1413 - DNA, 61 bp, Homo Sapiens
gctggcacaccctcctacaatagaagcacasaaggctttgccataggctctgctttccggg

SEQ ID NO: 1414 - DNA, 61 bp, Homo Sapiens
tgcacgtgattttcttcagaagagggagtgyggtaccctagaacagacacctggaagctca

SEQ ID NO: 1415 - DNA, 61 bp, Homo Sapiens
aagcagggaatccaaaaattattctatgagrtatgtggtattataaaggtttttatactaa

SEQ ID NO: 1416 - DNA, 61 bp, Homo Sapiens
ccactctataaagaggagcagtatcatggarttgcctttctgcacagaagctgctgttcat

SEQ ID NO: 1417 - DNA, 61 bp, Homo Sapiens
cactatcccagagtcagagctataactgaaygctcaagttagggtctttcaggaatatgtc

SEQ ID NO: 1418 - DNA, 61 bp, Homo Sapiens
tgtcatccaggctggagtgcagtgacattawcatagctgtttacagccttgaactcctggg

SEQ ID NO: 1419 - DNA, 61 bp, Homo Sapiens
cacaacagagattctatcaagttctctttaycttggtgatatggtttggctgtgtccccat

SEQ ID NO: 1420 - DNA, 61 bp, Homo Sapiens
tgttccagcacaatttgttgaagatattatyccttagcccactgaattgtcttgacaccct

SEQ ID NO: 1421 - DNA, 61 bp, Homo Sapiens
ctatacctgcaaaatttctccttttgttggytctttgcgaagttcattacatgcagaagtg

SEQ ID NO: 1422 - DNA, 61 bp, Homo Sapiens
caacgtgcaaaactgtctttgatttatgacytgagtctggacttaaaccgagtacgaggca

SEQ ID NO: 1423 - DNA, 61 bp, Homo Sapiens
cccagccatctggagtcatggagacccaccwcgtctctatgccggatgacctttgtaagtt

SEQ ID NO: 1424 - DNA, 61 bp, Homo Sapiens
tgtatccataaaaaataaaattggaattcayagttctgaaatcaaacaggaggacactagc

SEQ ID NO: 1425 - DNA, 61 bp, Homo Sapiens
tcagacaagatcaacttgaagaccatgaagrcctgtaataaacacaactaaggcagttgcc

SEQ ID NO: 1426 - DNA, 61 bp, Homo Sapiens
ccaatcacctggatattgagaccatcgataycctggaagacaccatcaatgagtttgaggg

SEQ ID NO: 1427 - DNA, 61 bp, Homo Sapiens
tagctgttcaagggatgatgagtctgaatgsgtaaggatcatatattagtagtaaattcat

SEQ ID NO: 1428 - DNA, 61 bp, Homo Sapiens
tttggtctttaattaaactttactcctccawctcatgcaacacgtgcacgttagacactag

SEQ ID NO: 1429 - DNA, 61 bp, Homo Sapiens
ataaagtgttgagtatctcatgtaatttctscaataccgtactgaaagtgaaaaacagaat

SEQ ID NO: 1430 - DNA, 61 bp, Homo Sapiens
atgtgtaagtcaagccattggggaccatttsaagttagttcattttcattactatagaaca

SEQ ID NO: 1431 - DNA, 61 bp, Homo Sapiens
gctatcttaatcttaaactaaattcacctcyatctgaagtttacctcttttctttaatata

SEQ ID NO: 1432 - DNA, 61 bp, Homo Sapiens
gagatggaatagcaaggaaccagggtttgcygagttagaaaggattactgtttctctgctg

SEQ ID NO: 1433 - DNA, 61 bp, Homo Sapiens
taccacgtttacattcacttgatcgcatcayttaccagaagtttaccaggttaccacactc

SEQ ID NO: 1434 - DNA, 61 bp, Homo Sapiens
taaccaaaataaataaaagcatatattcatrgaaagactcaaacatgactactaattgcag

SEQ ID NO: 1435 - DNA, 61 bp, Homo Sapiens
taagataatatgtggtcccaaatggatgggraaaacttctgttgctttttctgtgtttctg

SEQ ID NO: 1436 - DNA, 61 bp, Homo Sapiens
gttggagaagattctgaacagagtcttgtarcatcctgttcctgggtcccacagcctagct

SEQ ID NO: 1437 - DNA, 61 bp, Homo Sapiens
cagcagccattctagtagacaggttctcctrtgatagatgccggccaggtaaaggagacaa

SEQ ID NO: 1438 - DNA, 61 bp, Homo Sapiens
cagaaactatatgataaatggcaatacagckttggtgatatttaaaattaaaaatgtcaga

SEQ ID NO: 1439 - DNA, 61 bp, Homo Sapiens
aggagcaaaactattagaacttcctacacaygaagagcagtcccaagcatccagggaaaga

SEQ ID NO: 1440 - DNA, 61 bp, Homo Sapiens
gattttttttttaagtgaataagagcacaayatttcagcatgtgcaatatcacaaacagag

SEQ ID NO: 1441 - DNA, 61 bp, Homo Sapiens
cacattttcaggtttataattttacccattwatcagtgaaaggaatcaaactttcacatat

SEQ ID NO: 1442 - DNA, 61 bp, Homo Sapiens
tcaaataaacatttagtgagatcagtaaacrgtcagtgttcctaaaaagtacacccaaatg

SEQ ID NO: 1443 - DNA, 61 bp, Homo Sapiens
tatcctaaaaattgcttactactcctcaacrttgcctttattttcccatctgcatttctcc

SEQ ID NO: 1444 - DNA, 61 bp, Homo Sapiens
agctcatctgatcctcacaaccaaacatcamtgagttggatagtatccccatttaacagaa

SEQ ID NO: 1445 - DNA, 61 bp, Homo Sapiens
tgacggtagaattaagtttgaggaagattcraggatatggattaaacagtcattcttctta

SEQ ID NO: 1446 - DNA, 61 bp, Homo Sapiens
taaatggcaatggtaggtatatacacttagrtcctattttaggcttgtgggaagtgatggg

SEQ ID NO: 1447 - DNA, 61 bp, Homo Sapiens
aatggaatttttctgaattctatttttaccyaagtcaactaatctttcaacatcagtttta

SEQ ID NO: 1448 - DNA, 61 bp, Homo Sapiens
tacagtttatggaaatgaggaaaagtctcargtcaatagtaaaatttctaggaaaaaatct

SEQ ID NO: 1449 - DNA, 61 bp, Homo Sapiens
cagtaagaagtaaagtttcaagtgcaagttyctcaatggtcagctaatgaatgattttgaa

SEQ ID NO: 1450 - DNA, 61 bp, Homo Sapiens
aaagctagtgaaatctgaataatatcagtgrattgtgtttatgtcagtttcctggttgtga

SEQ ID NO: 1451 - DNA, 61 bp, Homo Sapiens
agtcttgaatctctactgccatgaaacaatwtaccatttgtgaaaataattgaaaaatttt

SEQ ID NO: 1452 - DNA, 61 bp, Homo Sapiens
cattttatacctgctttcaagtgcatactayaattttagctaggatatatagaccaaggtt

SEQ ID NO: 1453 - DNA, 61 bp, Homo Sapiens
caaggccaaaagctctcctttgatctttctrtgattcttctgtctttacaagtgaattttc

SEQ ID NO: 1454 - DNA, 61 bp, Homo Sapiens
gacattcaaagccatcgagatgttctctgtsactctcataggtcgctaatgattatcattt

SEQ ID NO: 1455 - DNA, 61 bp, Homo Sapiens
tacacaaaatgaatagtgggaggatgaatayggttttgttagcttttgctttgtttttatt

SEQ ID NO: 1456 - DNA, 61 bp, Homo Sapiens
caagaataagtatgtgaagatataattgcasttactgaacagaactctggttaatctggta

SEQ ID NO: 1457 - DNA, 61 bp, Homo Sapiens
cctttctgcacttgcctagtagaggatctcsttgagggctattccctgcagccaacatctg

SEQ ID NO: 1458 - DNA, 61 bp, Homo Sapiens
aggaactattcaagatagcctcgattcatgwcctgaatgtgtgtagataaatttataatat

SEQ ID NO: 1459 - DNA, 61 bp, Homo Sapiens
tgatgtcattggcaccttgaagaaggaataycactaggaagcatggaagataccaggagaa

SEQ ID NO: 1460 - DNA, 61 bp, Homo Sapiens
aaacatttatatattattaatagttggggawtttctcaaaatatgttatgaaatgaaactc

SEQ ID NO: 1461 - DNA, 61 bp, Homo Sapiens
ctaaaactggtaaagattaaactttttctgygccctgtattcccatgagtgtatttcatat

SEQ ID NO: 1462 - DNA, 61 bp, Homo Sapiens
ggagagttcccctcttcttgcctgacaccaygtttatgtgactttgtgttcattcacctcc

SEQ ID NO: 1463 - DNA, 61 bp, Homo Sapiens
cctagccagacacattgagctagaaactaargatagagagcaacagagtcctagagaccaa

SEQ ID NO: 1464 - DNA, 61 bp, Homo Sapiens
gtattcctctgaggagtatttgacttaggtsattttgatttcactcatgctggctgcagta

SEQ ID NO: 1465 - DNA, 61 bp, Homo Sapiens
catttgtaaaatataggttcagaaagcataytggactgtagttttcttttctggttttagt

SEQ ID NO: 1466 - DNA, 61 bp, Homo Sapiens
tttccatgaggttagggataacatcttagtyggtagccttgtttgtattcatatagcactt

SEQ ID NO: 1467 - DNA, 61 bp, Homo Sapiens
ggaggcacctttgaagatcttccagccttastaaagcattcagatacctgcagcttcagct

SEQ ID NO: 1468 - DNA, 61 bp, Homo Sapiens
tcaggagagaaaaaaaatacttgattggtayctcatggggctgttgtaaggaacaaatgag

SEQ ID NO: 1469 - DNA, 61 bp, Homo Sapiens
tgtttctaattatattacagctttcatctaygtggtgttccacattttatatttaagcaag

SEQ ID NO: 1470 - DNA, 61 bp, Homo Sapiens
gcttgctcctcctgtgtagatgtttttccawcatactatgccaccttcagttacttatgca

SEQ ID NO: 1471 - DNA, 61 bp, Homo Sapiens
cagtatttcaaatgcctgaagcctgacaaayttacattcttaacaggcaaacacttttcca

SEQ ID NO: 1472 - DNA, 61 bp, Homo Sapiens
agctttacaacctcaaactccttggtggatrttagaaccttatagaattacttcattcgat

SEQ ID NO: 1473 - DNA, 61 bp, Homo Sapiens
gttctggcagtttctgaactcttaatgataytttgatgacatccagttagatgctgaatac

SEQ ID NO: 1474 - DNA, 61 bp, Homo Sapiens
aaagtgaaatagactataagagtggtcaacrtggaataactgctgccaaaccctttctgct

SEQ ID NO: 1475 - DNA, 61 bp, Homo Sapiens
agctatcaaataataggcattccatcaaacrgcaagggtgacctcttccaagatgcacata

SEQ ID NO: 1476 - DNA, 61 bp, Homo Sapiens
tttaactttgttgcacagagaatctggctcstttatcatacagcaggccaaggactcagag

SEQ ID NO: 1477 - DNA, 61 bp, Homo Sapiens
agggtagaaagcttatttaaagacatactawcatgaaccacataatgatgttttggtcaac

SEQ ID NO: 1478 - DNA, 61 bp, Homo Sapiens
taatgaatctaaagacccctgaaaacccttsaagtgctacataaatattcagaaatggttt

SEQ ID NO: 1479 - DNA, 61 bp, Homo Sapiens
atagattaatttcacaaacagagttaatcasgtttgatgtttggtttcatgtttctaaata

SEQ ID NO: 1480 - DNA, 61 bp, Homo Sapiens
tgtctatagctccagccaccacgtccttgcrgatgacttcccagtgcagatccccagtctg

SEQ ID NO: 1481 - DNA, 61 bp, Homo Sapiens
cactggaattatttttcttttgtcaagccartaatctcccaggcatggtggtgtgcatctg

SEQ ID NO: 1482 - DNA, 61 bp, Homo Sapiens
gttcagggctggctcctccactttctgttgrtgtggaccaagtccagctctgcacctacct

SEQ ID NO: 1483 - DNA, 61 bp, Homo Sapiens
gtcagcttctctgtctcagtctacaaaataygtggcctcaaggctggtgggacctcatccg

SEQ ID NO: 1484 - DNA, 61 bp, Homo Sapiens
gatgctcacacctgcacagaatgtcacctayatacacggcaggactgtgtgcccacccctg

SEQ ID NO: 1485 - DNA, 61 bp, Homo Sapiens
gcctaccccaagctgcatctctagcttgcgrccatgcctctccccttcgagagccttggcc

SEQ ID NO: 1486 - DNA, 61 bp, Homo Sapiens
tttattgctaattatttgtctgtccacattrttatcatctcctagagaaattgctagaaga

SEQ ID NO: 1487 - DNA, 61 bp, Homo Sapiens
aacaactttaatagaattttgtgtctggagyagtacgtggcaagtatttggttactggcct

SEQ ID NO: 1488 - DNA, 61 bp, Homo Sapiens
ggttttaggtgttacttcagcatccataacytatgtggagtctaagaaagtaggctcacta

SEQ ID NO: 1489 - DNA, 61 bp, Homo Sapiens
aaaagaccggaatatctctcagtcagtgaamtcattatttgcctacatgaccagtttgaaa

SEQ ID NO: 1490 - DNA, 61 bp, Homo Sapiens
tctgtagataccgccagtgtagttacctacmttttagctgctgaaactacaactcttatct

SEQ ID NO: 1491 - DNA, 61 bp, Homo Sapiens
acctttgatttctaagtgaacttcattcttygccatccctaatttattccttgcaacacac

SEQ ID NO: 1492 - DNA, 61 bp, Homo Sapiens
gcaatataagctcaaagcctaaagtgtatcrttcacagaaaggaattcatctccaatctca

SEQ ID NO: 1493 - DNA, 61 bp, Homo Sapiens
tgatgaggcagtaggtgagcatcactgagaytgtgtgagtcaggccccagtcatacaagac

SEQ ID NO: 1494 - DNA, 61 bp, Homo Sapiens
cacaacattcagaaactaaatacgtggagascatctaacaatgagctgggtcctgtgctag

SEQ ID NO: 1495 - DNA, 61 bp, Homo Sapiens
aattccattttatcattttggagttgttcartctccaaaggtagttatccttgattcctct

SEQ ID NO: 1496 - DNA, 61 bp, Homo Sapiens
cattcttcattctcagttggcaaatatactrtgtaccgtctcctcttcagcccctctgcta

SEQ ID NO: 1497 - DNA, 61 bp, Homo Sapiens
ttttttatccactgaacatcttggtagtaarttaggttgattctttatgaacattttttta

SEQ ID NO: 1498 - DNA, 61 bp, Homo Sapiens
tgctgaataagctcctagaagaccatctttytcatttaagcacaaacttcaattctatcta

SEQ ID NO: 1499 - DNA, 61 bp, Homo Sapiens
gataaatatttgtatatgcagtgatgctcamatttcccaaacttcttaaacaggtcaactg

SEQ ID NO: 1500 - DNA, 61 bp, Homo Sapiens
atagtttttatccttgtctacacaatgtttsccaaagagagggctggtaaaatgtggccat

SEQ ID NO: 1501 - DNA, 61 bp, Homo Sapiens
ttcggtctctgggcatgcccattcctctgtstggactttattcccaactacatctccctgt

SEQ ID NO: 1502 - DNA, 61 bp, Homo Sapiens
aaaataagatgcgcttcagtcaactctcaaytgcctccacatttcaacattcttggacctt

SEQ ID NO: 1503 - DNA, 61 bp, Homo Sapiens
actttcaaagactattaatgataaatgaagrgtttcgtaatatagtattaagtgaaaacag

SEQ ID NO: 1504 - DNA, 61 bp, Homo Sapiens
cgacttttataatttgggcttcagcatgagyatcaaaacggcagcagagcagagtgagact

SEQ ID NO: 1505 - DNA, 61 bp, Homo Sapiens
ttaatgcacaggaatatgatgccgtaacaaygactttcctttctatggtgggaagagatag

SEQ ID NO: 1506 - DNA, 61 bp, Homo Sapiens
acacagtaaatacctgacacatcaatccaayagtacctttggcaaatgtatgagacagttg

SEQ ID NO: 1507 - DNA, 61 bp, Homo Sapiens
gctttgatcccagccaagataatatgttgargttgtctttgaatgcatgtatttgacattt

SEQ ID NO: 1508 - DNA, 61 bp, Homo Sapiens
ttactgtacttacaagactcctttgaatttytggagaacattaaaaagtgttgtcttgtac

SEQ ID NO: 1509 - DNA, 61 bp, Homo Sapiens
ttgagatatattgctcccagtgcaatctagyatagtatttttatattgatttattctgggg

SEQ ID NO: 1510 - DNA, 61 bp, Homo Sapiens
ggtaaggaaataatctatatatcaaaccccsaaaacatgcaattcacctgtactacaaacc

SEQ ID NO: 1511 - DNA, 61 bp, Homo Sapiens
aaagttaaattcatatcatgcatgtatagayggttaattcaaaatacaacttagaattctt

SEQ ID NO: 1512 - DNA, 61 bp, Homo Sapiens
gaaacagggaaatggcacaatctgaagagaygtggtatatgatcttaaatgatgaacatga

SEQ ID NO: 1513 - DNA, 61 bp, Homo Sapiens
tttgcataggattttgtccttaatgcctgaycgggtgtggtaactcacacctgcaatccta

SEQ ID NO: 1514 - DNA, 61 bp, Homo Sapiens
aaccttggaatgattgggagaggtggaaacyagctaaagagaatgatacagcatcaaccaa

SEQ ID NO: 1515 - DNA, 61 bp, Homo Sapiens
tttatgcagcttacactacattgtagacttytcatataggtgatctctaattctagaataa

SEQ ID NO: 1516 - DNA, 61 bp, Homo Sapiens
tactctgaagtagttgtttgaatctaccaasagttactgtgcaaacaattttatcagcatg

SEQ ID NO: 1517 - DNA, 61 bp, Homo Sapiens
tgccagtagcagctatcccatggtcttcacrtagttgggagactcactaagacgaagctca

SEQ ID NO: 1518 - DNA, 61 bp, Homo Sapiens
gaagttcagtgggcactagcaaatctgcacwatgcaactggaagaaacttgtatacatagc

SEQ ID NO: 1519 - DNA, 61 bp, Homo Sapiens
tgacttaaatagccccagcaagtccgcagaygctggagttgtggtccatctgtttttgttt

SEQ ID NO: 1520 - DNA, 61 bp, Homo Sapiens
atgactaaaatcatcacaattaccaagcaayggctttatcccagagttactttagaacaaa

SEQ ID NO: 1521 - DNA, 61 bp, Homo Sapiens
tcaggaaccatgcctaatatgtaccttaaawatgccttatactttggctccatattatttt

SEQ ID NO: 1522 - DNA, 61 bp, Homo Sapiens
ttataataggcacccagatcctgaaaatcayccacactacttgtcaggattaattgtttct

SEQ ID NO: 1523 - DNA, 61 bp, Homo Sapiens
tgaaagtaaaatatatatccgttgctcatcraagatgtcaactgctttgacttttccgctt

SEQ ID NO: 1524 - DNA, 61 bp, Homo Sapiens
gctatttgccaagctgcagaaatagcccttrgtgatataaataaatgatgtcacaaatgac

SEQ ID NO: 1525 - DNA, 61 bp, Homo Sapiens
cacagattatgcaggtggtcctggagactgscacataatggtgactgagatatgaaaagca

SEQ ID NO: 1526 - DNA, 61 bp, Homo Sapiens
taccccctgaactccagtttctctccattcsctttgattgctcagttcttactcaagctgt

SEQ ID NO: 1527 - DNA, 61 bp, Homo Sapiens
aactagcttccaccattctgtgtaatatatmgtgtttccttgcctgtgcacacctggttca

SEQ ID NO: 1528 - DNA, 61 bp, Homo Sapiens
catattatttccatattattttcctaagtcyaggtcttcaatggagtgtgtgtgcagatgt

SEQ ID NO: 1529 - DNA, 61 bp, Homo Sapiens
aaaaaatgacataaatagattctgatgttgyttcatttctgcagaagggtgtttttatatt

SEQ ID NO: 1530 - DNA, 61 bp, Homo Sapiens
tttactgttcatctaccttgcagacaaatgrcatttcttagatatcaattctttttgattt

SEQ ID NO: 1531 - DNA, 61 bp, Homo Sapiens
tgttgtgactaaacaatcctagtttctttcrtctctttcaatgaaaggaaacatgtctgtc

SEQ ID NO: 1532 - DNA, 61 bp, Homo Sapiens
ccctgggctgagtgccttccctttgaccaaygctgaagccttggaaatttatagaaatgat

SEQ ID NO: 1533 - DNA, 61 bp, Homo Sapiens
aatttgctttgagcactgggttagtgaaaamaagctcatgggttacagggccaatagactc

SEQ ID NO: 1534 - DNA, 61 bp, Homo Sapiens
actagataattatcaccaacaaagcattccrgaaaaaccagaacaatcaaaaggattacat

SEQ ID NO: 1535 - DNA, 61 bp, Homo Sapiens
gcggaaacctgccacaatccctagtcaacaytgcctgagaagcaccatttggcctccctgg

SEQ ID NO: 1536 - DNA, 61 bp, Homo Sapiens
agaaaaacaagaatcatctgaacttggcttygaagaataaagaggagcttattaggtaagt

SEQ ID NO: 1537 - DNA, 61 bp, Homo Sapiens
tgggattccccaggaccacagactatggatsgagtagaagaggtgggagacactcatccaa

SEQ ID NO: 1538 - DNA, 61 bp, Homo Sapiens
ttttttgctttcttttgaaaatgtgctatcygtattgattttctcaaaatgtagtgttgaa

SEQ ID NO: 1539 - DNA, 61 bp, Homo Sapiens
gttgatcttatacaggttagagatagcttgwggaagtttagataaaaagcaaacacctatt

SEQ ID NO: 1540 - DNA, 61 bp, Homo Sapiens
aggatcaaaatgaaagacagaactcagttcrtcatggtagccacagaatggagtttcaaga

SEQ ID NO: 1541 - DNA, 61 bp, Homo Sapiens
tgtgaccatcagaaagacataaattttacaytgtgacccagaacaacactcacacatacac

SEQ ID NO: 1542 - DNA, 61 bp, Homo Sapiens
agattaatgttccatgcctttgtggtcaaasggtcagcacttaacacaggaaaaaactagg

SEQ ID NO: 1543 - DNA, 61 bp, Homo Sapiens
gtgtatatagaacaaacaggagagaagatgyctgcaagaatctaataccttcctaggaaat

SEQ ID NO: 1544 - DNA, 61 bp, Homo Sapiens
ccacttaataagagatcttgaaaatcccccrtcctccagtgtggatttaatgcattcttgt

SEQ ID NO: 1545 - DNA, 61 bp, Homo Sapiens
atcccagaggactcatccccgtctgtgcgayaccatctccccacttctacgccaagctgct

SEQ ID NO: 1546 - DNA, 61 bp, Homo Sapiens
ccattgactggacggctcatcaacagcagaygtttatttaccgggtttggagtctataaag

SEQ ID NO: 1547 - DNA, 61 bp, Homo Sapiens
  misc_feature (31)..(31): n is a, c, g, or t
aatttcacatacattatctgatttttcaacnggtggccagtttaatgtcagaaatgtttcc

SEQ ID NO: 1548 - DNA, 61 bp, Homo Sapiens
ctgaaatcactcagtgcggcaatgataataytgatcttggacctgattctcgattctccct

SEQ ID NO: 1549 - DNA, 61 bp, Homo Sapiens
tccttctaaagtgaccagatttaaagatcargaccagtcatttggagatgaaatgaagaat

SEQ ID NO: 1550 - DNA, 61 bp, Homo Sapiens
tgctgggttaaaacacttggctaacatatgsttgccaaagataaggtgcctatttaaaaac

SEQ ID NO: 1551 - DNA, 61 bp, Homo Sapiens
cgatattcaatctacctttcagtttacaaaytcactctgtagctttgtctcatctgcttaa

SEQ ID NO: 1552 - DNA, 61 bp, Homo Sapiens
atatatatatccacataaaaacataaacatmatcactgctaatatcacaagtatactacaa

SEQ ID NO: 1553 - DNA, 61 bp, Homo Sapiens
acacactgtggtgttatatttgttcaacagyctccaatcagagaatctgagccttcaataa

SEQ ID NO: 1554 - DNA, 61 bp, Homo Sapiens
tatatattcagtatatcattttatatttgascaaaatcacaaatctattaatattgctaag

SEQ ID NO: 1555 - DNA, 61 bp, Homo Sapiens
gcaagctcttgatgcatagactcacaagcaraagtctacttattgagatactgtgttgata

SEQ ID NO: 1556 - DNA, 61 bp, Homo Sapiens
tacttattgagatactgtgttgataacatgrtataactttcatgttgcttctctctaactt

SEQ ID NO: 1557 - DNA, 61 bp, Homo Sapiens
tattgctggagtccattatgccttttaagamctatgcctcttaaacagtacggtgcttgtg

SEQ ID NO: 1558 - DNA, 61 bp, Homo Sapiens
atgttcaaatcctccaactccagtaacataratctcttttcttcactttttggcaaaatca

SEQ ID NO: 1559 - DNA, 61 bp, Homo Sapiens
tttaccacaatatttattttggatcagctayaaaagtaatgtcagaaacttcatttcagtt

SEQ ID NO: 1560 - DNA, 61 bp, Homo Sapiens
gagagaatgtgtctggccaaaagacatcccmattgtttaaagacaatacatatgtgtgtgc

SEQ ID NO: 1561 - DNA, 61 bp, Homo Sapiens
ttcagtggtttgaattttctttgaacccagsagaagtgaacagatgtggattttacaattt

SEQ ID NO: 1562 - DNA, 61 bp, Homo Sapiens
acagaggaaattgtccatttttaatgtctasgttcaaccaagtgtggacagccatctagaa

SEQ ID NO: 1563 - DNA, 61 bp, Homo Sapiens
aaggggatgtttcagtttgatttcagggctstaaaaaatggtgaagccattaaaagagaca

SEQ ID NO: 1564 - DNA, 61 bp, Homo Sapiens
aataaaccttaaaataatttattgctttcayggtgattttattgaaaacgtcacttccttt

SEQ ID NO: 1565 - DNA, 61 bp, Homo Sapiens
cgtcgcccaaatggtgagcattgtacgcaayaggtgacctttcaatacttcctccccgcaa

SEQ ID NO: 1566 - DNA, 61 bp, Homo Sapiens
tttagaggttaatataatctgatgtccttawaatgagatgagatcaccaagatgagtacta

SEQ ID NO: 1567 - DNA, 61 bp, Homo Sapiens
caaaggcagcctcacacttttctgctcagtrttcagttgacacctgcccttgttttgcttc

SEQ ID NO: 1568 - DNA, 61 bp, Homo Sapiens
ctcatttcttcctaaatgaaaggagaatccrttgaagtttttctttttttccttttttttt

SEQ ID NO: 1569 - DNA, 61 bp, Homo Sapiens
aatgaacaattttacatttttgcgaaatcartgaccacattcaaagcaagaagaacgaagt

SEQ ID NO: 1570 - DNA, 61 bp, Homo Sapiens
ccagtgagctgagatttgcagttgcttattstgtattctgtgggtttgaactgtgtaagta

SEQ ID NO: 1571 - DNA, 61 bp, Homo Sapiens
tttcttaaataggagaatactatttatcaaytcatttcatgggattattgtgatagtgaaa

SEQ ID NO: 1572 - DNA, 61 bp, Homo Sapiens
tagtaaaagcaaccagtcacaaagacgaggrgaaaactctttggaagttcttcaattcttt

SEQ ID NO: 1573 - DNA, 61 bp, Homo Sapiens
attctccatgtaccctgcatggtagtgctgsaaactttaaagtacatttctttcacagcag

SEQ ID NO: 1574 - DNA, 61 bp, Homo Sapiens
ctgccctcacccattgtgctcaaaactccayggactctcccctcccagagggctcaaggca

SEQ ID NO: 1575 - DNA, 61 bp, Homo Sapiens
tactttaaaaaattatttttattgaaggcaraaaccccaatgccataaggtaagtcagcac

SEQ ID NO: 1576 - DNA, 61 bp, Homo Sapiens
caggtgatgctgaatgtggactcaggcagarccggaatgtatgcttggtccacacatggcc

SEQ ID NO: 1577 - DNA, 61 bp, Homo Sapiens
agatgtacataaggcccaggagaatgataayatctgctttgtggtcctcatgtgtgactat

SEQ ID NO: 1578 - DNA, 61 bp, Homo Sapiens
tgaacttcgggggttagaagggaagagagtmggtgccccattggtttgttaccttcccaac

SEQ ID NO: 1579 - DNA, 61 bp, Homo Sapiens
gagatattccaacctcgcaatagactttccstcatgtagaaacattctgaacctacgataa

SEQ ID NO: 1580 - DNA, 61 bp, Homo Sapiens
ttccatttcaagacttcaagaaagatgtgamtacccagcagatatcacactttcggttctg

SEQ ID NO: 1581 - DNA, 61 bp, Homo Sapiens
accggcaatgcttgtctaagtgtgaagcttyctgagaatgtgttcgctcaaacccactgtc

SEQ ID NO: 1582 - DNA, 61 bp, Homo Sapiens
accccagcgcaggcacttccgggcctaagcrtttctgcaggaaccccaaggccacagctgt

SEQ ID NO: 1583 - DNA, 61 bp, Homo Sapiens
ttccaagaagcaaatcaatcagaagaacacrggttccctgagctgtccactcagctgaaat

SEQ ID NO: 1584 - DNA, 61 bp, Homo Sapiens
tcaatccctcacaccaatgtaatgaaacctygatagaagctctgcatgctgaggcccaggt

SEQ ID NO: 1585 - DNA, 61 bp, Homo Sapiens
gctgcttccaaaaccaaacattctcttactrtgtgatccagtgattacactccttggtact

SEQ ID NO: 1586 - DNA, 61 bp, Homo Sapiens
acataaaaatactcattgaagcaattctttyagcatagatgggcaacatgcggaggttatt

SEQ ID NO: 1587 - DNA, 61 bp, Homo Sapiens
caatgagttacagtatatacaaagccaacasaacagtaataagtacttaatacttactaga

SEQ ID NO: 1588 - DNA, 61 bp, Homo Sapiens
ggcaaagtttgtagagtctttttgtcttaayatttccacatgtaacagggaactgtccatc

SEQ ID NO: 1589 - DNA, 61 bp, Homo Sapiens
aaatgataaagctatatttctggattttaaygaaccagagatacacagtcagaatttcgtt

SEQ ID NO: 1590 - DNA, 61 bp, Homo Sapiens
tacattttagtgtctatacaggtgagggctrtattcatatgtagacatgtctacattccct

SEQ ID NO: 1591 - DNA, 61 bp, Homo Sapiens
atatggatggaccccacagacttaaggttgsaggaaagaagctggacaaacaggaccttcc

SEQ ID NO: 1592 - DNA, 61 bp, Homo Sapiens
tgcttgatttttcccaatctcattcattcartattgtttcagtgtgatgttttgctaaatt

SEQ ID NO: 1593 - DNA, 61 bp, Homo Sapiens
gggtatataattactgctcagtgaaagtgaytatgcatacctgtatcatctaaaggaattt

SEQ ID NO: 1594 - DNA, 61 bp, Homo Sapiens
catccaaagatactatataagaaagacatayggcagatgcagaattccaaaaaaattatga

SEQ ID NO: 1595 - DNA, 61 bp, Homo Sapiens
caaacatttcttaaatcaagtttgttatctrtattactcactgcttcattgctattttatt

SEQ ID NO: 1596 - DNA, 61 bp, Homo Sapiens
tatggatgaatggatggatgggtgaaataayagataaatggacaaaacgatggaagggaag

SEQ ID NO: 1597 - DNA, 61 bp, Homo Sapiens
tcacctcctcttccatgggtttcttcttccrtgactcactgacttagtagctgggcaacgt

SEQ ID NO: 1598 - DNA, 61 bp, Homo Sapiens
atactgaagtcacttaggagcaacacttacrgaactccacatcacatggccctaccctcat

SEQ ID NO: 1599 - DNA, 61 bp, Homo Sapiens
tgtctgacttgggcattaatgagatgaagaygagactgtaggtcagatgatgactgttttt

SEQ ID NO: 1600 - DNA, 61 bp, Homo Sapiens
ctgcagtattttggcctttcaggaaaagatstgctcaaagaccaattgaacattcttttct

SEQ ID NO: 1601 - DNA, 61 bp, Homo Sapiens
cgcatcccccagctgctctcctttcatcccrctgtcagagtcaggaatccacatgcaaagc

SEQ ID NO: 1602 - DNA, 61 bp, Homo Sapiens
ttgccatctgttgactgtttttatagtcttrgccttttcttcacgttcagtgtaaggccct

SEQ ID NO: 1603 - DNA, 61 bp, Homo Sapiens
gcctggccatttaataatttatgagtgactwtctgatactgtatctagataaccaacccct

SEQ ID NO: 1604 - DNA, 61 bp, Homo Sapiens
cagttttctgcagtcttcccagccccacggmaaattctgcttttgtcagaggaggggatat

SEQ ID NO: 1605 - DNA, 61 bp, Homo Sapiens
cacgtccagagtcccgagctgctgccgtctraaacgcagggctgctacgctgccatggctg

SEQ ID NO: 1606 - DNA, 61 bp, Homo Sapiens
gctgctacgctgccatggctgggtccgtcartgaaagtcttctctttcctctttttccagt

SEQ ID NO: 1607 - DNA, 61 bp, Homo Sapiens
taccaaaggaaagccccttcaagttaccgtwaagacagaagaaaaggaagaaaaatataaa

SEQ ID NO: 1608 - DNA, 61 bp, Homo Sapiens
aaactttgtgtacactgaaccaacagaaagsagctgtcggttctaagaccattgttagtgg

SEQ ID NO: 1609 - DNA, 61 bp, Homo Sapiens
agcatacaaaggagttttatcgtaaacattyaagcaccgtgtataatcaaattacccataa

SEQ ID NO: 1610 - DNA, 61 bp, Homo Sapiens
ttaattccacacttacagtctgcaaattatytccaccgaggaccagtctgtagtccagatg

SEQ ID NO: 1611 - DNA, 61 bp, Homo Sapiens
tcccaggacatctatttatttaggacatagmatttgtagccataaaagcaaatcatattaa

SEQ ID NO: 1612 - DNA, 61 bp, Homo Sapiens
ggcacataatgcctaaatgagtggcttccartacatgtggaatcactacttaaagttactg

SEQ ID NO: 1613 - DNA, 61 bp, Homo Sapiens
gctccatttacacttgtaacaggcaactttsctagattaatcttgtccaaactaatgcaac

SEQ ID NO: 1614 - DNA, 61 bp, Homo Sapiens
tgtagaaatctttactagctgtaaataaagsgtgacaaaagtcatatggtcattctgaaat

SEQ ID NO: 1615 - DNA, 61 bp, Homo Sapiens
gagaaatatgctttgctatctaatacagaamatttgaactatttgtatcgccatttgggac

SEQ ID NO: 1616 - DNA, 61 bp, Homo Sapiens
gggaccaactgaacataacctgcttaaaagwtccacctaaattattggaatccttttatat

SEQ ID NO: 1617 - DNA, 61 bp, Homo Sapiens
tacatggatcttgttgcaaaataaaagggcrctctgagaaactaaatggaaattaaacatt

SEQ ID NO: 1618 - DNA, 61 bp, Homo Sapiens
agaagaacagtctggaaggtactggtaagartgactcaaggagaggagagttctgtccatt

SEQ ID NO: 1619 - DNA, 61 bp, Homo Sapiens
cgcagcaaaattatcagactaaaaacaataytgcaagtaatttgtgtgtacccacaattat

SEQ ID NO: 1620 - DNA, 61 bp, Homo Sapiens
aggaccctcatgctcaacttcaagtaccacractatcttggattttgcaaactacaatgcg

SEQ ID NO: 1621 - DNA, 61 bp, Homo Sapiens
cagcactgtcatgaaaaacaaagaaggcgaytcctcctacacagcagagttgttcagaaag

SEQ ID NO: 1622 - DNA, 61 bp, Homo Sapiens
ggtagatccctcatgaatggcttgatgccaygcttatgataatgaggtagttcttgcttta

SEQ ID NO: 1623 - DNA, 61 bp, Homo Sapiens
gtgtcctggtttagacagtaaatggttattstgcttaatgcaagccaagttaaagaactat

SEQ ID NO: 1624 - DNA, 61 bp, Homo Sapiens
accaaaccacagtcaatatcaatggcagaayagcaggcattaactggaactgacccaggca

SEQ ID NO: 1625 - DNA, 61 bp, Homo Sapiens
tcagcctttctcttacagctaaaagtgatcrtggcacgacacaggggcaatgagctctaac

SEQ ID NO: 1626 - DNA, 61 bp, Homo Sapiens
tatcaggtcaagtgaaaaacaaattgcggartgattagtacgttgccatttatgtaaatca

SEQ ID NO: 1627 - DNA, 61 bp, Homo Sapiens
cgtttatcaccattcttattttgtgcagtgsaatggactcctgactttgtgaccttcagaa

SEQ ID NO: 1628 - DNA, 61 bp, Homo Sapiens
ggagaacccagaaataaatctatgtacttaycacaaactgattttttgacaaaggcaccaa

SEQ ID NO: 1629 - DNA, 61 bp, Homo Sapiens
caaggtctctaaataggtactgggaataggyggagattatccttgcagactgtatcattga

SEQ ID NO: 1630 - DNA, 61 bp, Homo Sapiens
gtgtttttgctagcatgagaaggtttcagayggtaaagattagaagaatacaaaaattact

SEQ ID NO: 1631 - DNA, 61 bp, Homo Sapiens
aaagctaattttatgaattaggagtagataygtagtgaagaaagctgcctatggctgcctt

SEQ ID NO: 1632 - DNA, 61 bp, Homo Sapiens
aagccatcaggtttaactacagttaaatcaygtgaaaagcaaataaaaacctaaggtaaga

SEQ ID NO: 1633 - DNA, 61 bp, Homo Sapiens
atatatgcaattcatatactttgaaaaaatraacatggtgatatttcatagcctattttat

SEQ ID NO: 1634 - DNA, 61 bp, Homo Sapiens
aacagtcttattttcattggttgtttcttargcattttagaaggaaaaaggcagaaaatgt

SEQ ID NO: 1635 - DNA, 61 bp, Homo Sapiens
tgagtggcatcatataatatgtggtctgtartgactgacttctttcacttagcataatgtt

SEQ ID NO: 1636 - DNA, 61 bp, Homo Sapiens
atacaagtcaatggttttaatatagtagagytgtgcaaccatcaccacaatctgtgcttag

SEQ ID NO: 1637 - DNA, 61 bp, Homo Sapiens
ctggatgggtctgtggctggggtagtgcggygaagggagaatgctatggcaggctacacac

SEQ ID NO: 1638 - DNA, 61 bp, Homo Sapiens
ctttccagatcatagtatatgtatataagtsacttactgggaagagcactacatcatagtt

SEQ ID NO: 1639 - DNA, 61 bp, Homo Sapiens
gtatctacggagccctcaagaaaatcatgcrgaccgaaggcttctggaggcccttgcgagg

SEQ ID NO: 1640 - DNA, 61 bp, Homo Sapiens
taatagcgatgaagaattttatcagtcagtkgagttcctttttcagatcagggatgggaaa

SEQ ID NO: 1641 - DNA, 61 bp, Homo Sapiens
aatttgggagaaaagagcttggtttgcatcsataagggctttgtaggagacaccctcatgg

SEQ ID NO: 1642 - DNA, 61 bp, Homo Sapiens
ttatctggcatttgtgccagatacatagacrtattcatgcgttgttactagtaaaggaaaa

SEQ ID NO: 1643 - DNA, 61 bp, Homo Sapiens
ccctgtcatctaacagttcaaataagaaaaragattgtgtgttttcatgcagtttagcttg

SEQ ID NO: 1644 - DNA, 61 bp, Homo Sapiens
tgatacgggagtaagtcattcatgggatgcrttttctaaacaacctttccatgtccacttc

SEQ ID NO: 1645 - DNA, 61 bp, Homo Sapiens
gacaacactatgaagttaatttgctttcctktaccagacacctctgagctgattaattcta

SEQ ID NO: 1646 - DNA, 61 bp, Homo Sapiens
ctcatcacacatcataaataacacgttattrattgagtggaagggaacgtttccccagcct

SEQ ID NO: 1647 - DNA, 61 bp, Homo Sapiens
ctttgtggaaggagtttggcagccatattayaatcacgagaccaacaagcatgaggatgag

SEQ ID NO: 1648 - DNA, 61 bp, Homo Sapiens
tcaaggggcatcctggctttataataaaccrctttgttttttgagacagaattttgctctg

SEQ ID NO: 1649 - DNA, 61 bp, Homo Sapiens
tgctcttttctatactggctattttatattycatctcctgtattgttttattgttattttt

SEQ ID NO: 1650 - DNA, 61 bp, Homo Sapiens
gtgcgtgacagggagacaactgccgatgctsttaccactcaaggcaggagtgcttctaagt

SEQ ID NO: 1651 - DNA, 61 bp, Homo Sapiens
ttatcgcttatgttaatagtaattcccgtaygtgttcattttattttcatgctttttcagc

SEQ ID NO: 1652 - DNA, 61 bp, Homo Sapiens
gtctcttccagagctgtgggtgcttgcaaartcaagaaaacaaaagcttggatagcaagag

SEQ ID NO: 1653 - DNA, 61 bp, Homo Sapiens
acccacataaatgagacatctgtcctagagrtgccacctgtgtcttgtgaaagccatttaa

SEQ ID NO: 1654 - DNA, 61 bp, Homo Sapiens
cagtacattagtagcatctaaacagttctartttttccatgtttgtatagattccattgct

SEQ ID NO: 1655 - DNA, 61 bp, Homo Sapiens
atcagggaagtattatattccctatgctgaragttgttaagtataagggatgtgcctgtta

SEQ ID NO: 1656 - DNA, 61 bp, Homo Sapiens
ttaagagatgtaaaggaaatgactgctgaaktatcagggaagtattatattccctatgctg

SEQ ID NO: 1657 - DNA, 61 bp, Homo Sapiens
caatagttgctcatttgttttagccactgaraattgactgagttctccacttggaacatgt

SEQ ID NO: 1658 - DNA, 61 bp, Homo Sapiens
taaaggttgaagaaggcagaaaaggtgttgwctagatcattggttaataaaactgaccaaa

SEQ ID NO: 1659 - DNA, 61 bp, Homo Sapiens
atgaagtcaaagcccctcctcctcttgtccrtagatagagtagaccaactcacagaacttc

SEQ ID NO: 1660 - DNA, 61 bp, Homo Sapiens
atcatgaggaaagagctctaaaaagatctgkgtcttgttccaactctgtggtgccactcaa

SEQ ID NO: 1661 - DNA, 61 bp, Homo Sapiens
caccataagagtgccaggtgtctgagttcarccctttctctgaaatagctttttcatttgt

SEQ ID NO: 1662 - DNA, 61 bp, Homo Sapiens
gccctggcctggcctaggaattggaagaacrtagtcctcacgtgccagatcagtgatttgt

SEQ ID NO: 1663 - DNA, 61 bp, Homo Sapiens
tgtatgtcctgtctccaaagtgtgtggcttwaagtcaggttctgtgcttttgatgacaata

SEQ ID NO: 1664 - DNA, 61 bp, Homo Sapiens
actacgtttcattttattcatgagaaaattyattcccagtgagatgaatggggggtactgt

SEQ ID NO: 1665 - DNA, 61 bp, Homo Sapiens
ggcaggtcatgagtgattcctgaatgataaragattccataggatttcagagaagagtcac

SEQ ID NO: 1666 - DNA, 61 bp, Homo Sapiens
gctggtaaccaggtgttgttgacaccagccktatccagacacgtcctatgccattttggtg

SEQ ID NO: 1667 - DNA, 61 bp, Homo Sapiens
atgaaatcagtagcaatatcctggaaagatytgaaaccatgaaaataattaaaaacaatgt

SEQ ID NO: 1668 - DNA, 61 bp, Homo Sapiens
aaaaaaaggaatatttaaaatagtcaaaaaycttctaaaagtcaataaagaaaaaagtcaa

SEQ ID NO: 1669 - DNA, 61 bp, Homo Sapiens
tttgagatgaatttgaaagggaaaatgctaytgctttgaaacagttacctctttccaagaa

SEQ ID NO: 1670 - DNA, 61 bp, Homo Sapiens
ttttttaagtttgatagttaaataagtagcmgcatggtatggagggaggagcagaaactgt

SEQ ID NO: 1671 - DNA, 61 bp, Homo Sapiens
tttatttttttctgagaagcttaactctacsagctttgaaatatgagtactaatattttta

SEQ ID NO: 1672 - DNA, 61 bp, Homo Sapiens
ttacccagatcatgtaagttatcaaatctgygggcatagagttgttcacagtgttcctcta

SEQ ID NO: 1673 - DNA, 61 bp, Homo Sapiens
gtagtattatcatacagagattatttcagtytgtgagaggaaccacagtatccccccaaat

SEQ ID NO: 1674 - DNA, 61 bp, Homo Sapiens
tctcatgactttatttgcatttctctggttrctaataagattgagtacttttcacgtgttt

SEQ ID NO: 1675 - DNA, 61 bp, Homo Sapiens
ggtggaatgtactttacaataactcttaagwtctacagaaaaggccatattgcttgtaatt

SEQ ID NO: 1676 - DNA, 61 bp, Homo Sapiens
aaagaaaagaaaaagaaaaatgcagtacaarataagtgttagaacatatggagaagatagt

SEQ ID NO: 1677 - DNA, 61 bp, Homo Sapiens
ttgtattgtggaaggtctttttctcataacygctgctgggaaacattcaacagaaattcct

SEQ ID NO: 1678 - DNA, 61 bp, Homo Sapiens
tctgacattctggagtgtggtgttagaatcrtggactttgaggtcagacacgcctggtgta

SEQ ID NO: 1679 - DNA, 61 bp, Homo Sapiens
tataattttgcatgggaatcatgatttgccrttcaaattgctccagattacatccataatc

SEQ ID NO: 1680 - DNA, 61 bp, Homo Sapiens
tcttagaaaaccacatatctcaaatggtttmggtttactcctgcctagacttaagagactg

SEQ ID NO: 1681 - DNA, 61 bp, Homo Sapiens
agagttgataagtagacaagttggtacctayacttggtgacctgtctcagtgtggtcagtc

SEQ ID NO: 1682 - DNA, 61 bp, Homo Sapiens
tttcccctttacttgttgatgagtttttgtytcattgagtcgtcagaaaacattgtgttta

SEQ ID NO: 1683 - DNA, 61 bp, Homo Sapiens
cctgtgtcaccttggtttaaatactggagcractactaactagctggatacccggctctac

SEQ ID NO: 1684 - DNA, 61 bp, Homo Sapiens
ttagttacttcattactttccccctgacctyatcctgaaaatactgtaacatggcaagcta

SEQ ID NO: 1685 - DNA, 61 bp, Homo Sapiens
tgcaactatctccgtcagcaaaatagacccwgttgctgctctctcagagattgcagtttag

SEQ ID NO: 1686 - DNA, 61 bp, Homo Sapiens
ttctccagagtagctctgtctagcatagtgrcaagtctccaggttattaggactctgtggt

SEQ ID NO: 1687 - DNA, 61 bp, Homo Sapiens
aaacgggtatccccagcatggaggctgattkgcttggccgttctacagaagacaaagttga

SEQ ID NO: 1688 - DNA, 61 bp, Homo Sapiens
tgttgggtttcaatatcttaccacaactgcyatcgagggaggtataagtctcaccataact

SEQ ID NO: 1689 - DNA, 61 bp, Homo Sapiens
cagacctagcatagcaaattggaagttatayataggctcataggttactctggttgataga

SEQ ID NO: 1690 - DNA, 61 bp, Homo Sapiens
accattttccatgtatacttctttaagctamttccacttttttgttgtgtgaaagaatgaa

SEQ ID NO: 1691 - DNA, 61 bp, Homo Sapiens
tgtcctggaaacgcttctttgttttacattygttcttctgctttagaataattccataatt

SEQ ID NO: 1692 - DNA, 61 bp, Homo Sapiens
cttattcatacacagactcacataaggcaartatcaactttgttcctttcatgtttattaa

SEQ ID NO: 1693 - DNA, 61 bp, Homo Sapiens
tgggaccaccatcatctatgtggttcatcawggactgaagctctgttatgcaccacatgac

SEQ ID NO: 1694 - DNA, 61 bp, Homo Sapiens
caggaccatgaaggatttcaagtaggtacaygacaatcacatgggtattttacaaagatca

SEQ ID NO: 1695 - DNA, 61 bp, Homo Sapiens
attgggggtgtttcaaagcctataatcaaamtaaacagactggtacaacaactactaaatg

SEQ ID NO: 1696 - DNA, 61 bp, Homo Sapiens
atgctagaggatggtgttatgaatagataaytttgtcattaaatgacgtccactgctatga

SEQ ID NO: 1697 - DNA, 61 bp, Homo Sapiens
gggagggaattccttgatgaagttaatggaygggagatggttcctgcatgtaaaatcagga

SEQ ID NO: 1698 - DNA, 61 bp, Homo Sapiens
tttttcagtgcctgccattttttattagtgrctccttaacaatctggcaggatatatagcc

SEQ ID NO: 1699 - DNA, 61 bp, Homo Sapiens
cctgtgagagcgcacacagtctgaggtttgycaagagatggttattatagtggacactgaa

SEQ ID NO: 1700 - DNA, 61 bp, Homo Sapiens
gttggaggagagctagtgccttaattggtaragtccagatattttaagacaaacagctgca

SEQ ID NO: 1701 - DNA, 61 bp, Homo Sapiens
ttattttggaatgatgtcagagatttctttsggagcactctactgcagcggacctcaactg

SEQ ID NO: 1702 - DNA, 61 bp, Homo Sapiens
ggaattgtcttaatgtttcttaaagtcatartatactacagctagaaaatatctttcagaa

SEQ ID NO: 1703 - DNA, 61 bp, Homo Sapiens
aacagtggtaaacatttctttgctattatcrtcatcttttgactggccagtgtattgaaga

SEQ ID NO: 1704 - DNA, 61 bp, Homo Sapiens
tactcagattggccttgcgcctcatgccgtrggtagtcatgctgactgggcctcctcccaa

SEQ ID NO: 1705 - DNA, 61 bp, Homo Sapiens
aagaaaagagagtgtaaaactctagaaggamtgtagattgtttgcaaagttttaagccact

SEQ ID NO: 1706 - DNA, 61 bp, Homo Sapiens
agggaaagttaaatgggacactgaagattayactttgtgggtgtgattcaaacagtggaca

SEQ ID NO: 1707 - DNA, 61 bp, Homo Sapiens
cctagatccttctatctccatagcaagcagrgtcgagattctacttcatatatatttgaat

SEQ ID NO: 1708 - DNA, 61 bp, Homo Sapiens
gattctaacctgtgaatggttgtggtaagtraagcaatacctaagtgttcccggaccaaac

SEQ ID NO: 1709 - DNA, 61 bp, Homo Sapiens
gagaaatagaccaaaggatgaaggttttagrcatttatgtacccatgatgtaccttaaaca

SEQ ID NO: 1710 - DNA, 61 bp, Homo Sapiens
aagtgtagactgggaggtagaacatgtactrcttgtaattgccaaatttacgtgtggaaca

SEQ ID NO: 1711 - DNA, 61 bp, Homo Sapiens
ctctggaaactttaagacctaggagcttatsagaaatgcggaatctctggctgtgtcaaga

SEQ ID NO: 1712 - DNA, 61 bp, Homo Sapiens
aagttcaaaacttcatcaatcttagaacctwaccaaactgaattggtttatcgtaactcac

SEQ ID NO: 1713 - DNA, 61 bp, Homo Sapiens
ggaaggaagaaaaagagaagaaaataacaarctactctggctccataaacatgacttgcga

SEQ ID NO: 1714 - DNA, 61 bp, Homo Sapiens
gacatagttgggcatgaaaactcaaatgttygccaaagctaggtagggaaagttccagaat

SEQ ID NO: 1715 - DNA, 61 bp, Homo Sapiens
ttgctagcctagtccaaacattctctgagcrcagggattctgcctggcttgtttgttcagg

SEQ ID NO: 1716 - DNA, 61 bp, Homo Sapiens
cgtaatacattgtgctataagtttgatccarttagatagctcaaataacagattaatattc

SEQ ID NO: 1717 - DNA, 61 bp, Homo Sapiens
tctgactatatttgtatcactctgtgaacamaccagatgggcatcctgggagccatgaagc

SEQ ID NO: 1718 - DNA, 61 bp, Homo Sapiens
aataccagttggactgagagccttttcaatygtaggtaagagacagtcacagagactccca

SEQ ID NO: 1719 - DNA, 61 bp, Homo Sapiens
tgtttaaaaattgggctgttcttatactcarcagacattatattcttccttgagatagtat

SEQ ID NO: 1720 - DNA, 61 bp, Homo Sapiens
tcaaaatgtgtttaacggatgtttgttataygcagttttctctatcctaaacagtgatgct

SEQ ID NO: 1721 - DNA, 61 bp, Homo Sapiens
aggctgggtgtattactgacagtgagatttsagtcgtgtctcacagtcttattgccgagca

SEQ ID NO: 1722 - DNA, 61 bp, Homo Sapiens
ttttgcttgactttccctttgcgctgtctcrtgggaaaggtcattctgtctgagaccccag

SEQ ID NO: 1723 - DNA, 61 bp, Homo Sapiens
ggctgggatgctctcagaataatcattgtgygcattcccaagggtgtctgggaccatacat

SEQ ID NO: 1724 - DNA, 61 bp, Homo Sapiens
caatactctgcagactcgaaaaaacatyacrtacattcttggaacttcccagtggtttaat

SEQ ID NO: 1725 - DNA, 61 bp, Homo Sapiens
catttgtaaattatttaataattatgtattrtccactatgagctaagcagtggagatacaa

SEQ ID NO: 1726 - DNA, 61 bp, Homo Sapiens
ccatcctgaaagcaaaaggttcagagagagygtgaggtagagggaaatgagggcagggaga

SEQ ID NO: 1727 - DNA, 61 bp, Homo Sapiens
gagcagggtgggtgtgccctcctaagctctsgaatagcaaatgccaaactcacatgtctgt

SEQ ID NO: 1728 - DNA, 61 bp, Homo Sapiens
ttccacagagaactagaaagaaaaagagcaygaaagtgatagatgcaagaaagaacgagag

SEQ ID NO: 1729 - DNA, 61 bp, Homo Sapiens
tcactcggcagccattctcaggacctgaaaygccctcctttccaactcaacctctcccatt

SEQ ID NO: 1730 - DNA, 61 bp, Homo Sapiens
ttattcacacataaaaaccaatatattttasttcacgctatttacactatgctggttgtag

SEQ ID NO: 1731 - DNA, 61 bp, Homo Sapiens
ggtcttagaaaccatggatttaagagcaacrtgaattaaatgtccaggaaggtgcgaaatc

SEQ ID NO: 1732 - DNA, 61 bp, Homo Sapiens
cctcaagataattccagaatattagatttgycaggacttacttaaccttcagtgcattggc

SEQ ID NO: 1733 - DNA, 61 bp, Homo Sapiens
aaacctttttcccaaagcctgatttgatggygtagctaaagaaatggttagttatttcaca

SEQ ID NO: 1734 - DNA, 61 bp, Homo Sapiens
ctttcaataaaataggtccattaatgtagcrcacctcactctcattctctccaagggagtt

SEQ ID NO: 1735 - DNA, 61 bp, Homo Sapiens
cagaaatataggtggtctggaaagcaacctygggagtttgtagttatgtcactactggcag

SEQ ID NO: 1736 - DNA, 61 bp, Homo Sapiens
cctccttgttacctgtaacaaatctaagttraggttattggcattaatccctccctgcccc

SEQ ID NO: 1737 - DNA, 61 bp, Homo Sapiens
aactgtttgtgcaaatcgcctgtaagcttaytgacctgaatctttgactccttgttttctc

SEQ ID NO: 1738 - DNA, 61 bp, Homo Sapiens
cagagtgatactccatttagtctgtgaaaawgtaatcaaaaggtcactcacctaagtggta

SEQ ID NO: 1739 - DNA, 61 bp, Homo Sapiens
ggagagtagagtatggtttaaactacagaaygaagtgtacagattttagattctggcatgt

SEQ ID NO: 1740 - DNA, 61 bp, Homo Sapiens
ataagccactctcttcataagaccataccarttttctaataaagctcacacagatttcgtg

SEQ ID NO: 1741 - DNA, 61 bp, Homo Sapiens
ggcttgccttatactttgcctcttaaatacrtcatcaaatgaaaactatgtttaggaatgg

SEQ ID NO: 1742 - DNA, 61 bp, Homo Sapiens
ttttggactagtccaggtatcaactgtgatyattcaggtcctcaaacaaacagtaaaaaac

SEQ ID NO: 1743 - DNA, 61 bp, Homo Sapiens
aaaaagaataaaataataaaattatgagtcraacacaaaaatgaaaacacttacctgagct

SEQ ID NO: 1744 - DNA, 61 bp, Homo Sapiens
cccttggatcttttgtaactgaaaagttgcygaatctctacctaaaatctaaattggaaaa

SEQ ID NO: 1745 - DNA, 61 bp, Homo Sapiens
tacagggtacaataaaacaaataaccagagmtttttatatacatgtaaaagggcactgcaa

SEQ ID NO: 1746 - DNA, 61 bp, Homo Sapiens
ctgaagcaaacaaacagcaacaacaaaatgsttttaagtataaatgttgccttaggaggat

SEQ ID NO: 1747 - DNA, 61 bp, Homo Sapiens
tttctcaagggcctctattcattctttcatwctcaaatcaccctacattgaaatatctatc

SEQ ID NO: 1748 - DNA, 61 bp, Homo Sapiens
ttaaaatatgtcatttttaaaattcgtactyagcgcaatacttacaaagttgctattttcc

SEQ ID NO: 1749 - DNA, 61 bp, Homo Sapiens
tacaatgaagtactagaagacagtacaaggwcttttccatcatttttgaaaacctcagaat

SEQ ID NO: 1750 - DNA, 61 bp, Homo Sapiens
ctttggtaaacatgcagatatttttctggcwtaaggtacctcagaatcaattgattaatct

SEQ ID NO: 1751 - DNA, 61 bp, Homo Sapiens
acttagaattactctgtataagtaaatgaawactcagtaatacacactacttatcaaattt

SEQ ID NO: 1752 - DNA, 61 bp, Homo Sapiens
aaacctagattaggctaaaactatctctacrtcatcatcacaaaggggtgaaaaatcagtg

SEQ ID NO: 1753 - DNA, 61 bp, Homo Sapiens
ctactccagctatgtgggtttatctcatcakctataaagggtagcatttattaagggttta

SEQ ID NO: 1754 - DNA, 61 bp, Homo Sapiens
ttgttcttcatacttctgtttcgtggtattkgctctagctgttccctaaagcagtatcttc

SEQ ID NO: 1755 - DNA, 61 bp, Homo Sapiens
ctaaagcagtatcttcacttaccagtaaggyttattcctgcaccaccttccactacttgct

SEQ ID NO: 1756 - DNA, 61 bp, Homo Sapiens
gtcaaccaaagaggcaatatacttttgcccycttggattttacattctatcaggtgaagac

SEQ ID NO: 1757 - DNA, 61 bp, Homo Sapiens
acaacggcataatcgacagtgtcaaaagagwtaaggagattggagacaactgaggtattag

SEQ ID NO: 1758 - DNA, 61 bp, Homo Sapiens
ttattctactataataagataggattgattmgttatcttcaaatttgacaaattgtctata

SEQ ID NO: 1759 - DNA, 61 bp, Homo Sapiens
tacaaagaagctagaatgtacataagaaacwagcacacaccttggaaaacagttagaaatc

SEQ ID NO: 1760 - DNA, 61 bp, Homo Sapiens
ttttttttttctgagttactacattaatcamataagtggcctccctatggctggtatgttt

SEQ ID NO: 1761 - DNA, 61 bp, Homo Sapiens
ccattcttggaaaaaatgtgggtaagcatcratcttgacacagtcctaagcatttagacat

SEQ ID NO: 1762 - DNA, 61 bp, Homo Sapiens
ttctgaacctgttgaacgacttccacagggygctaggaaaaaatggcaaaaatatcatttt

SEQ ID NO: 1763 - DNA, 61 bp, Homo Sapiens
gaattttgtattccaaagaacaatatatgayttaatgccattttgagtactaaatataagc

SEQ ID NO: 1764 - DNA, 61 bp, Homo Sapiens
tggttttcaaactttctcaaattttgtagtwtcatcaacagctatcatttttgattgctct

SEQ ID NO: 1765 - DNA, 61 bp, Homo Sapiens
aatgcatgacatagatttttatgtggatacrctaacacagcatctctaaggaggttaaact

SEQ ID NO: 1766 - DNA, 61 bp, Homo Sapiens
aacaccgcacatattagactgtagggtctakacttatcctcaagaataaaaccaatatcaa

SEQ ID NO: 1767 - DNA, 61 bp, Homo Sapiens
gaacagcggacacaattatagatcaggaagrctgaaataaatgtgtaaatgggaggtaaaa

SEQ ID NO: 1768 - DNA, 61 bp, Homo Sapiens
gttgcatgttctcactcgtatgtgggagctrtgaaagtagatttcatgaagacagagagta

SEQ ID NO: 1769 - DNA, 61 bp, Homo Sapiens
gagaagtttagaaaagggactatttgcaagracacaagcagagtgtagggaacccccaggt

SEQ ID NO: 1770 - DNA, 61 bp, Homo Sapiens
acactagggagaggacctaggacctttttcrttcagcattgccggagttgctttgggtcaa

SEQ ID NO: 1771 - DNA, 61 bp, Homo Sapiens
tctatactaaatcctgattctgtcccttgtytgaactcacagtgtacccatgtaattctac

SEQ ID NO: 1772 - DNA, 61 bp, Homo Sapiens
aatgcttggacaataatgtttgcttcaaggygagcctgtgttgatctctgagggtgcattt

SEQ ID NO: 1773 - DNA, 61 bp, Homo Sapiens
taaatgtatttacactgttgtacaatagacytctgaaactttttcatcttgtaaaactgaa

SEQ ID NO: 1774 - DNA, 61 bp, Homo Sapiens
gattctttgattcattcatttaacacgtttyattgagtggctactctgccccatgcacatg

SEQ ID NO: 1775 - DNA, 61 bp, Homo Sapiens
ctttctgttgccctccaattctactactctmcgctgactctgtcatttatatcctgattgg

SEQ ID NO: 1776 - DNA, 61 bp, Homo Sapiens
tatgtctttggtccaggatccaaacaaggaycatgtgttgcatttagtcacaatgtttcta

SEQ ID NO: 1777 - DNA, 61 bp, Homo Sapiens
ttcaccttggttctctgacacccatggaaartttaggttagggagagagagtggaaagaga

SEQ ID NO: 1778 - DNA, 61 bp, Homo Sapiens
agctgtcctgaagatgcctcctgctaagacrggttgcggaggggagtcagtggctgaaagg

SEQ ID NO: 1779 - DNA, 61 bp, Homo Sapiens
tatgcgctagatggaaaatggattggctagwtcagctagtaatgtctgctacaaccgcagg

SEQ ID NO: 1780 - DNA, 61 bp, Homo Sapiens
aggtttttaaacactgtaagatgattccagwtttttagatagctcagagggccgtggggac

SEQ ID NO: 1781 - DNA, 61 bp, Homo Sapiens
gggctaacacatgatgactgccctttcaagygtcattccaggaagacatggttaaaagcaa

SEQ ID NO: 1782 - DNA, 61 bp, Homo Sapiens
aaggaagaaaacatgaaacacacaacaaagrgtgggtagaaaaatgcctggtagaaatgca

SEQ ID NO: 1783 - DNA, 61 bp, Homo Sapiens
tatgttcaataaacactgtatgttttgctcrgtctcacaactgtctgtttccttccagtaa

SEQ ID NO: 1784 - DNA, 61 bp, Homo Sapiens
gggaatatttacatgcggtattattttccarcttgtacacagcaccctctttattgctaag

SEQ ID NO: 1785 - DNA, 61 bp, Homo Sapiens
tggagactgtgcaagaatccaaaatgaccaygtgggtacaataaacccttccaaagcagct

SEQ ID NO: 1786 - DNA, 61 bp, Homo Sapiens
gcaagaacagtgctgtcctcttgtttaatcrtgggagaggtgagaggagaaggaaggcatt

SEQ ID NO: 1787 - DNA, 61 bp, Homo Sapiens
aggcctttgaagcttaaccatcattggcttsatgataagggcacttgtgataaagcaaact

SEQ ID NO: 1788 - DNA, 61 bp, Homo Sapiens
tgataaagcaaactgtatttcattattgtargtgtcggaagatgctaacaccttggataac

SEQ ID NO: 1789 - DNA, 61 bp, Homo Sapiens
taccccgcatgctgttctcattatcctcccraaaaacgaagccccattcctcagctttaaa

SEQ ID NO: 1790 - DNA, 61 bp, Homo Sapiens
gccgtgcctggaacattctctgcttgaagamctctcgtggcgggggctcaggtccttcatg

SEQ ID NO: 1791 - DNA, 61 bp, Homo Sapiens
cttgagtgaaagagacagctcctgtggtgaratgggcctgagctcaaaccctggctcactc

SEQ ID NO: 1792 - DNA, 61 bp, Homo Sapiens
ttccatgtactccctggtctgtctgcaccaygagactcaggcatgtgacggtcaggtcctg

SEQ ID NO: 1793 - DNA, 61 bp, Homo Sapiens
gcattcacagatgtcatttgctcaggcaaaygaagataaataattttttgtgtgtttctcc

SEQ ID NO: 1794 - DNA, 61 bp, Homo Sapiens
cagagcaggcccactccagttaactcccacygtcatctcgtctgtttgtctatgcatccat

SEQ ID NO: 1795 - DNA, 61 bp, Homo Sapiens
gaggaacagatagagagggacaatacagccyggtacaggagatgaagggccccggggccat

SEQ ID NO: 1796 - DNA, 61 bp, Homo Sapiens
gtacctcttctaggaaagcccttgagcaacragcaatctcccagtcaccacccagagccat

SEQ ID NO: 1797 - DNA, 61 bp, Homo Sapiens
aggcatctgctgcccttacctgtgggatgcygtactggtcgatgacctgccagatatacca

SEQ ID NO: 1798 - DNA, 61 bp, Homo Sapiens
tggctactgcacttatgagcatgtaatgtaygtaaatggtttaatgtatgttaatggttta

SEQ ID NO: 1799 - DNA, 61 bp, Homo Sapiens
cagacaaggaaataaatgcttatatttccayatggtcagtggacatggtgtcatgggagct

SEQ ID NO: 1800 - DNA, 61 bp, Homo Sapiens
agatcaaaggcagatgggcacttgagtctayagctcagaaaagaaactggagctggagata

SEQ ID NO: 1801 - DNA, 61 bp, Homo Sapiens
ggctctggagtctgccagtttcacagagctmgtccctgaggacacatctggtttgtgagaa

SEQ ID NO: 1802 - DNA, 61 bp, Homo Sapiens
gggtgctggcgggatcagggcttactctagycttgtcctcttaggctcaggtgatcctccc

SEQ ID NO: 1803 - DNA, 61 bp, Homo Sapiens
cacagaaaccggcaaggttctgttcggaccrgaagcacccaaagcaagtcagctggacgcc

SEQ ID NO: 1804 - DNA, 61 bp, Homo Sapiens
agcgtttttctttacccttatcaaatgtcaytgtgagttaacagctcttgaaaaagtagaa

SEQ ID NO: 1805 - DNA, 61 bp, Homo Sapiens
aaagggaccctgcagccataggaagtgactyggggaagttgtgtagtgctgggaagtctgc

SEQ ID NO: 1806 - DNA, 61 bp, Homo Sapiens
ctcctctccaagatggcatctggataaagaygtggtgtttaagcatggcattgggggcgag

SEQ ID NO: 1807 - DNA, 61 bp, Homo Sapiens
caaatcagatattaggatcttgaacctaaaytgtgaatctctttgtgcctttaaccacatc

SEQ ID NO: 1808 - DNA, 61 bp, Homo Sapiens
taaaaatgacctccaagcatgtaaaatgttyagcataggctgggctcctagcaaacactgt

SEQ ID NO: 1809 - DNA, 61 bp, Homo Sapiens
tggttttccccgtagccagttaatattttayatgcatcacagccagcatggtgcctggtac

SEQ ID NO: 1810 - DNA, 61 bp, Homo Sapiens
gtaaactttttcaccattctgcaataagacragcccagaaattaggaataagtgtgtagaa

SEQ ID NO: 1811 - DNA, 61 bp, Homo Sapiens
aatgcagcctcccttttggacttttcagcakgtggaacttaaagaagaaaaaaaactgtga

SEQ ID NO: 1812 - DNA, 61 bp, Homo Sapiens
gacttggataagctggaggccacacctacartgctttctggagacaagtccttgcccttgg

SEQ ID NO: 1813 - DNA, 61 bp, Homo Sapiens
cttacgtaagcagccctctcctgagacttayagcgtaaccttaatgtaacacaatattttc

SEQ ID NO: 1814 - DNA, 61 bp, Homo Sapiens
tatgacctttcaagggtgtaatcacctttcrcacctcacctctcagcagcatgaccctgag

SEQ ID NO: 1815 - DNA, 61 bp, Homo Sapiens
ggaggcaatgcctatgctgaatggtaaggcmtaagtaggagttatccaaatgaagaaggaa

SEQ ID NO: 1816 - DNA, 61 bp, Homo Sapiens
tttataatttatttaaccaacctctctctgrtaacggactttgaggttatttctaattttc

SEQ ID NO: 1817 - DNA, 61 bp, Homo Sapiens
ccctagtctaagcccccgttgtttatgtccsgatcttgcagtagcctctatattagttatc

SEQ ID NO: 1818 - DNA, 61 bp, Homo Sapiens
gaatttaggagactcatgcattgctgcattrttttagaaatggataaatgatttcgacttc

SEQ ID NO: 1819 - DNA, 61 bp, Homo Sapiens
aaaactttccctaccaactttgctgaaactrtctggaattttagttacagatttttctttt

SEQ ID NO: 1820 - DNA, 61 bp, Homo Sapiens
acatgataatccagtaagaattagttatttwattcagcaggatatgcacacagtgattgtg

SEQ ID NO: 1821 - DNA, 61 bp, Homo Sapiens
ccacctgggtgtgcttaaaaagagacaaacrtggtaacgatcaaataccctagataaaatg

SEQ ID NO: 1822 - DNA, 61 bp, Homo Sapiens
tagttaatgacatgaccatatttttattttygatgatcattccggtgttttagtgaatttg

SEQ ID NO: 1823 - DNA, 61 bp, Homo Sapiens
ggtgccattatttgaatgcatgaaacttctracctataagacatgaaatacattagccagt

SEQ ID NO: 1824 - DNA, 61 bp, Homo Sapiens
gccacttaataaataagggattgaagaatartggcttagagttggagagacagtatttagc

SEQ ID NO: 1825 - DNA, 61 bp, Homo Sapiens
tgcttaggaaacaaagacgagctaggagaaygggcttgaaaaaacagcatgcaagaggtaa

SEQ ID NO: 1826 - DNA, 61 bp, Homo Sapiens
aatgattcctggagataaagaagtcactctstttggaaaatatcaattctaactggcctac

SEQ ID NO: 1827 - DNA, 61 bp, Homo Sapiens
gaagatagtttgaagtgaatgataatgaagrtaagccatataacaacctgtaggttgcagc

SEQ ID NO: 1828 - DNA, 61 bp, Homo Sapiens
ccatcaacatccaggcaagaccttccactcrcaaaaatattaggagttgccaaagatttat

SEQ ID NO: 1829 - DNA, 61 bp, Homo Sapiens
aacttatgttgtcttctaaatataaggaacrctttgagatacaattgaaattcattaccta

SEQ ID NO: 1830 - DNA, 61 bp, Homo Sapiens
tattggcttgttttttaatctatcttccccrtcagactgtaagaaagctccagaaacactg

SEQ ID NO: 1831 - DNA, 61 bp, Homo Sapiens
agggctgaacccgtgaactcgatcaggactrattcctaacctttttcttcttttttttttt

SEQ ID NO: 1832 - DNA, 61 bp, Homo Sapiens
atttactttccttttccttcctgcttaatamacagctaacctttttacctgttagcattat

SEQ ID NO: 1833 - DNA, 61 bp, Homo Sapiens
atgtgcatgttcaacgtgccattcataccargaaatgacaattataagccttaattaccta

SEQ ID NO: 1834 - DNA, 61 bp, Homo Sapiens
cactgatttgcttccgtctatctacaatctyatcctgtcctgtgatattgaatctaaggat

SEQ ID NO: 1835 - DNA, 61 bp, Homo Sapiens
agatacgcatctatatttatgtcacacatayctgttttatttatgtatttatgcaccttta

SEQ ID NO: 1836 - DNA, 61 bp, Homo Sapiens
gtcttatttcagagaaccgatcttcaagttyggagattctttccttagcttggtgtattct

SEQ ID NO: 1837 - DNA, 61 bp, Homo Sapiens
actccaaagcctgaaggctagaacagctaargtgcctgaacagcaaagatggtggcccacc

SEQ ID NO: 1838 - DNA, 61 bp, Homo Sapiens
ggtagtaagaagcacaagggaataagcctgygatgcaataatttaatctgcctaaaattgt

SEQ ID NO: 1839 - DNA, 61 bp, Homo Sapiens
ttgtcttacttgtgttttaaaaaacaaatgsctcttgtactgtttccaagagtgcattctt

SEQ ID NO: 1840 - DNA, 61 bp, Homo Sapiens
cctcagcatggacaagtcttggcaaagaccrctatggcagcagtgtctgaaaaaggaaaag

SEQ ID NO: 1841 - DNA, 61 bp, Homo Sapiens
tgcatttctaggcataatgacataaacttakccaagagtccatcttataccagggattccc

SEQ ID NO: 1842 - DNA, 61 bp, Homo Sapiens
ggagcagatgttcaggtctgaatccagtttyttctagacacctctttccggatcaccccct

SEQ ID NO: 1843 - DNA, 61 bp, Homo Sapiens
catcttccccttgtccttctacggtggtttyctaacccaacagagtggtcctctgctccag

SEQ ID NO: 1844 - DNA, 61 bp, Homo Sapiens
atttcacttaattctctcagcaattctttgragtcagtactattcatacttccattttaat

SEQ ID NO: 1845 - DNA, 61 bp, Homo Sapiens
cacctggtaagtgtccctagcaacagagacrtaagaggttgagagaaaaatcattagaaag

SEQ ID NO: 1846 - DNA, 61 bp, Homo Sapiens
gacattttattttataagtaaaatcagaagscataatagccaacctggccaacttttgaaa

SEQ ID NO: 1847 - DNA, 61 bp, Homo Sapiens
ccatttaatccaagagggtccaccatgactktcgaatctaaaatactcttttcacagataa

SEQ ID NO: 1848 - DNA, 61 bp, Homo Sapiens
cccatcccacttctttgaaaggcttgaaatrctttactctccaatacccactgtctgcttg

SEQ ID NO: 1849 - DNA, 61 bp, Homo Sapiens
agtgggcaaaggaagagagaaacttctgaawatctaagagcaaactctgtagtaggatgcg

SEQ ID NO: 1850 - DNA, 61 bp, Homo Sapiens
gtttattttgtgtctatcagaatcaatacaycatcatatgtagcaattccaagggagctat

SEQ ID NO: 1851 - DNA, 61 bp, Homo Sapiens
gccaacacacattaaaggtcactattctgcrttaacttgaaaagagcaaaagcactgttta

SEQ ID NO: 1852 - DNA, 61 bp, Homo Sapiens
aaaacttacttgtcctttagtgtgcttctaratcttctgaaacactcacctcccttcaggt

SEQ ID NO: 1853 - DNA, 61 bp, Homo Sapiens
tagcctagaggaagggctcagacactgtgcrctaaactaactaaacacatgaaacacacca

SEQ ID NO: 1854 - DNA, 61 bp, Homo Sapiens
gtttggatgctgtttgagtaagacctacacygagaattctcttaaatacctagaatttgtg

SEQ ID NO: 1855 - DNA, 61 bp, Homo Sapiens
gtttaatatgttaaatagttctggctggacratggttccagataactggtagaagtaaatg

SEQ ID NO: 1856 - DNA, 61 bp, Homo Sapiens
tctgtgaacctaggatgtaagtttacgaagmccccttcctgctcacagcttttgagtttca

SEQ ID NO: 1857 - DNA, 61 bp, Homo Sapiens
agctcttgaatttaaaacctcagtttatagrgtaggttacatcacagttaatatttacatg

SEQ ID NO: 1858 - DNA, 61 bp, Homo Sapiens
aaaacctcagtttatagagtaggttacatcwcagttaatatttacatgtggcacagtggca

SEQ ID NO: 1859 - DNA, 61 bp, Homo Sapiens
atttcttacagtggcaattactgttgtgaarggattcacctctgattcatggctgaatttt

SEQ ID NO: 1860 - DNA, 61 bp, Homo Sapiens
actgtgctagagcctgagatgcaaagataaytaagtcacagactctggcatgacgacttct

SEQ ID NO: 1861 - DNA, 61 bp, Homo Sapiens
gcctgataaggaattgtacataccgttcttygtgaaaaccaagagtaccatgtatgtaaca

SEQ ID NO: 1862 - DNA, 61 bp, Homo Sapiens
gttctagttgaggaaaaggacatatccacarttttatagttcaccttacaaaatgactttc

SEQ ID NO: 1863 - DNA, 61 bp, Homo Sapiens
ggggggtatttctacacctccatgcagttgkaaaggaaaggtagtccttggaatttttatt

SEQ ID NO: 1864 - DNA, 61 bp, Homo Sapiens
aaaaaaacctatgtctagattagagtcaggkgcggtctccttattgtcagtgtctgctttc

SEQ ID NO: 1865 - DNA, 61 bp, Homo Sapiens
atgattcatggtggaaatgtctcctttgttmgataaattcctgcaaaccaatgcctggaat

SEQ ID NO: 1866 - DNA, 61 bp, Homo Sapiens
cctggtgtgccaggtactgctttgcttacaytgtttcaacttttgtatgtatgtccttatt

SEQ ID NO: 1867 - DNA, 61 bp, Homo Sapiens
agccaatacttctttagaaatatgacagatwtaataccaacactaggaccatttgaagaca

SEQ ID NO: 1868 - DNA, 61 bp, Homo Sapiens
ggcacctgcaatccaggattaagacattcaygcaacataaggcggatctatattacttagt

SEQ ID NO: 1869 - DNA, 61 bp, Homo Sapiens
tccaacctttagttcccagcaacaggaattraaaacaattgtatttcaaattacagtggtt

SEQ ID NO: 1870 - DNA, 61 bp, Homo Sapiens
ctctttacactttgcctcatgcttgttgtaycaaatcctacatcatcaatcaccttgcaaa

SEQ ID NO: 1871 - DNA, 61 bp, Homo Sapiens
aaaatgctaaccaaagacaggagactgtcaragaaaaagaagaatactcaaggactccagg

SEQ ID NO: 1872 - DNA, 61 bp, Homo Sapiens
gttcatccactgatgcccagtcagagacaaytggggtctgcccagtcagatgaacaagaac

SEQ ID NO: 1873 - DNA, 61 bp, Homo Sapiens
agccacaggtaacatgctacaatagaaacckgttagacaaacaacgtggtcaccctcaaat

SEQ ID NO: 1874 - DNA, 61 bp, Homo Sapiens
ttggtaaatttttcttagacacttctgcccractttcttttcctttctctcgccttcgctc

SEQ ID NO: 1875 - DNA, 61 bp, Homo Sapiens
cttcaaaaccagcagaacagtaacataatcmtgggagtgacatcccttcactcttgctata

SEQ ID NO: 1876 - DNA, 61 bp, Homo Sapiens
ttgtctgagagctgttatcatgagtgaatcytcaattttgtcaagtgcttttattgaattt

SEQ ID NO: 1877 - DNA, 61 bp, Homo Sapiens
tagattaaggcagagttttgaaaagagcggygagagaacagttttttaaaaaagaaaacgt

SEQ ID NO: 1878 - DNA, 61 bp, Homo Sapiens
ttgaatctctgaggggacactccaggaatckgcttcttacaagccctccaggtgatttgaa

SEQ ID NO: 1879 - DNA, 61 bp, Homo Sapiens
tgcatttgccatctgcagaaagaacgcataytataatgaaggagctctgcaaagcgcaggt

SEQ ID NO: 1880 - DNA, 61 bp, Homo Sapiens
tgtcaatgagatggcagattgctcagatgcytgttgttagctttgaaatgccatctaagcc

SEQ ID NO: 1881 - DNA, 61 bp, Homo Sapiens
tcattttttaaaaagctaggacttaggaaargaggtgatttgcttttgttttccatttgtt

SEQ ID NO: 1882 - DNA, 61 bp, Homo Sapiens
gaagccaggaggcaaagaagtccattgatgycatccctaaaagccagcctctcgacacaga

SEQ ID NO: 1883 - DNA, 61 bp, Homo Sapiens
catcaaattcctgtataaaatccttccattkactgagctgctgatctttgatgtcattgcc

SEQ ID NO: 1884 - DNA, 61 bp, Homo Sapiens
attttctcaaatcaaataaaaaatgatttgyggggtttgagagaaggtgttggagcccaag

SEQ ID NO: 1885 - DNA, 61 bp, Homo Sapiens
tgatataatatagtgcttgtgggtctttaastacatggcaccatgtagttaaaaagtgcat

SEQ ID NO: 1886 - DNA, 61 bp, Homo Sapiens
aaactctacaaatattccaacataattagaytcttctggtgtacaaaccaccgtaagactg

SEQ ID NO: 1887 - DNA, 61 bp, Homo Sapiens
gaatttgaagcttctcctatgacagactctrtgtgcaatttattgttggcctggttaagca

SEQ ID NO: 1888 - DNA, 61 bp, Homo Sapiens
ccgtggactggctactcactttcggtaattyttgacaacattccttaggtcaagaacaaag

SEQ ID NO: 1889 - DNA, 61 bp, Homo Sapiens
ctgtatttctcaatctgattttgaggaagtwattcttttcattgtcaaaggcatccttgtt

SEQ ID NO: 1890 - DNA, 61 bp, Homo Sapiens
aagcatgactgaagggaaagatatctcatgsggggagagttcctcatacaagagtatggag

SEQ ID NO: 1891 - DNA, 61 bp, Homo Sapiens
cctcagaaccagtcctgttacattggtttakccaggatccccccttacccctgatgtttcc

SEQ ID NO: 1892 - DNA, 61 bp, Homo Sapiens
gcagagccactgaatttagtgattggtaacraaatagttaaattgagagtgctagaatgtc

SEQ ID NO: 1893 - DNA, 61 bp, Homo Sapiens
cttgctgtgggagccaaggaaagcagattcrattctctctgggcaatgagggagaggagca

SEQ ID NO: 1894 - DNA, 61 bp, Homo Sapiens
gtggttttagacaactaagttgactttgtayaagctcaagctgcctttgttttgtgtccag

SEQ ID NO: 1895 - DNA, 61 bp, Homo Sapiens
tacaagctcaagctgcctttgttttgtgtcyagtgttgcaagtttggcagtgaggtttggg

SEQ ID NO: 1896 - DNA, 61 bp, Homo Sapiens
tgggcagtgatagtatcaatattatacacaytaccattaggccatagcccataaggccaaa

SEQ ID NO: 1897 - DNA, 61 bp, Homo Sapiens
cactacctggagaacagagttgaactgagargttgatagcacaatggaaggtacaggatgt

SEQ ID NO: 1898 - DNA, 61 bp, Homo Sapiens
aaagtattttgaaataaccatagaatggtartgaactaattatgatcccatattctgtgtt

SEQ ID NO: 1899 - DNA, 61 bp, Homo Sapiens
tgccattcccaaactatcagtgtggaaagtygtgatttagtttgaccccaagctctacttc

SEQ ID NO: 1900 - DNA, 61 bp, Homo Sapiens
gatgttagttccctgtcgaatgtagagtttrcgaatattttctctcattctgcaagttgtc

SEQ ID NO: 1901 - DNA, 61 bp, Homo Sapiens
catctttatgcacatttttttctgtatttcrgactggacatgatatatgtggctttttggg

SEQ ID NO: 1902 - DNA, 61 bp, Homo Sapiens
tgagagaggacttgaggttatgtagtttatytgagtgaagatcccggaagtagggagagaa

SEQ ID NO: 1903 - DNA, 61 bp, Homo Sapiens
aagaggcagcttacagggatatttaggggastttgttcagcatctgaatgcagagtatgag

SEQ ID NO: 1904 - DNA, 61 bp, Homo Sapiens
aaatggtaagtgttcagtaaatatttggagwgaggtaaaaggtgagcaagagagaaaaaag

SEQ ID NO: 1905 - DNA, 61 bp, Homo Sapiens
ggccctactggataatccagaataacctccrcatcttaagcacaactgcaaagtccctttt

SEQ ID NO: 1906 - DNA, 61 bp, Homo Sapiens
ttgatacatatattcttctttcagtgcttayttatgcacttacctctgttctttttctctc

SEQ ID NO: 1907 - DNA, 61 bp, Homo Sapiens
tcatcctatagagacagcgttttggaaaggracatataaaaatgattccacccttacatga

SEQ ID NO: 1908 - DNA, 61 bp, Homo Sapiens
gaatgaaattagaatgtcagtaaagagattrttaaacagaaccaaatcaaaattcgggagc

SEQ ID NO: 1909 - DNA, 61 bp, Homo Sapiens
acacatagataaaaaaatgggaaaacacacrtaatttcactagcataaaacgtagttggtt

SEQ ID NO: 1910 - DNA, 61 bp, Homo Sapiens
gggcccatggtacattccccaactcacactmcatgctgggttgtgaaataactcccaataa

SEQ ID NO: 1911 - DNA, 61 bp, Homo Sapiens
ggggagaggaaaaatatcactcttgcaaagytatgtggaaaagtagaacaattttactggg

SEQ ID NO: 1912 - DNA, 61 bp, Homo Sapiens
tgtaagcaccttgagagtaagttatgagtcyttcatgtgtcccctgcaccgaacacaggtt

SEQ ID NO: 1913 - DNA, 61 bp, Homo Sapiens
gggacctgactcaactggaacctttgtcttstagctggataaagacttggaagaggtcacc

SEQ ID NO: 1914 - DNA, 61 bp, Homo Sapiens
gtaggtcaaaagacctttatcacagagagaragtcttgccccataccctggaggaaggaat

SEQ ID NO: 1915 - DNA, 61 bp, Homo Sapiens
caaagtaacacatatcataagtcttggagayaggatttggatccagagggttgatcctaga

SEQ ID NO: 1916 - DNA, 61 bp, Homo Sapiens
tgggccttctcaggtaaagctcctgagatamgtgaatgccctgagtggagtggaactgctg

SEQ ID NO: 1917 - DNA, 61 bp, Homo Sapiens
ggagaccaagccaacaaattatagaatttcmacaaaggaatcattgctattctgctgcaaa

SEQ ID NO: 1918 - DNA, 61 bp, Homo Sapiens
gtccaaaattgcagaatatattttgctttakgtcatgtaccaaatgactaataggcagcga

SEQ ID NO: 1919 - DNA, 61 bp, Homo Sapiens
gatcacaaatcttaccttgtaagtcaatagstttttcatccgaacatattttcccatataa

SEQ ID NO: 1920 - DNA, 61 bp, Homo Sapiens
atctctccaagtctttctgttataattgtgygccctaaaactttgaaaataatagaagaat

SEQ ID NO: 1921 - DNA, 61 bp, Homo Sapiens
tgggggtttgttgtatagattatttccttgyccaggtattaagactagtacccatcagttg

SEQ ID NO: 1922 - DNA, 61 bp, Homo Sapiens
tgaggaacaatgcttcttccttctttctttygcttcctcttttactctctctctgctagtc

SEQ ID NO: 1923 - DNA, 61 bp, Homo Sapiens
tccccccgaccccgccccgcagtgacttagrgaaaattttagactcatctcttggcatgac

SEQ ID NO: 1924 - DNA, 61 bp, Homo Sapiens
aagcttcatttcctcactcctcattttgatwtgtataaattgctcctgtgttttcttttgc

SEQ ID NO: 1925 - DNA, 61 bp, Homo Sapiens
cttgagcccaggagtttcagtgaattctgaytgtggcactgcactccagtctgtgcaacag

SEQ ID NO: 1926 - DNA, 61 bp, Homo Sapiens
ggatcagataatgaagggtcttgaatgctaygctaagctgcttagaattcaccttataggt

SEQ ID NO: 1927 - DNA, 61 bp, Homo Sapiens
agagatagtcacttgcccaaaattacatggytagtgagagatagattgggaacatctgcaa

SEQ ID NO: 1928 - DNA, 61 bp, Homo Sapiens
tggttatccttgtttcttagttttattcatmtttccccccaaacaacattttgccttggtg

SEQ ID NO: 1929 - DNA, 61 bp, Homo Sapiens
gtggtagttaaaatcttgagaatggatttgstttcagggagagattgtagagagagtaact

SEQ ID NO: 1930 - DNA, 61 bp, Homo Sapiens
atttaataacttagtaaagttcaaaattgtsagttacttattaaacataaacatgtgacaa

SEQ ID NO: 1931 - DNA, 61 bp, Homo Sapiens
tatttctcagctatgagattttccgtggccrccttttcacagtagccagctgggattgtcc

SEQ ID NO: 1932 - DNA, 61 bp, Homo Sapiens
gttttggtttttttgtttttgttttttagcrcaggtccaattgtgatggagagctcatacc

SEQ ID NO: 1933 - DNA, 61 bp, Homo Sapiens
gcaatttagttacatcttcagacttcacttmtaatttgagttctcttgctatttcaaccac

SEQ ID NO: 1934 - DNA, 61 bp, Homo Sapiens
ctacaatttgagtctcatgttggctcttttsttcatttgtttttaattgactcatgatagt

SEQ ID NO: 1935 - DNA, 61 bp, Homo Sapiens
catcacatctaagtgtaagaggctgggaatrgggttccaaaaatctgggttctataatgca

SEQ ID NO: 1936 - DNA, 61 bp, Homo Sapiens
cctattcccagcctcttacacttagatgtgmtgtatcctcatttcttcattgcacatttct

SEQ ID NO: 1937 - DNA, 61 bp, Homo Sapiens
atttcaagagcatgcgaagaccacaagtttmtcaggaagcgtcctcccttctacttcctcc

SEQ ID NO: 1938 - DNA, 61 bp, Homo Sapiens
taaactgataatttactccttttacttgggygaaatgcaatagatactcttattttttttg

SEQ ID NO: 1939 - DNA, 61 bp, Homo Sapiens
agcattcctttttctccacaacctcgacaayatctgttggttttttactatttaatagtag

SEQ ID NO: 1940 - DNA, 61 bp, Homo Sapiens
attagtcagagcaaatatctataattttacytgcagagtcacagccctagctctgccaagt

SEQ ID NO: 1941 - DNA, 61 bp, Homo Sapiens
aaatcaaagttaaaatattcttcaggatcaytgaataaaaagctcataaagattcaaaaaa

SEQ ID NO: 1942 - DNA, 61 bp, Homo Sapiens
aaatggaatttagatatagcatttaacaaayggcaacataagtttcagttcttgttggaca

SEQ ID NO: 1943 - DNA, 61 bp, Homo Sapiens
tgcctcaccacctggggtctcaatggactayggatttggataaatttctgcaaaatggaaa

SEQ ID NO: 1944 - DNA, 61 bp, Homo Sapiens
tgtactttttaattgtagctttataattcastccttatcttctccctgcccctcccaaaaa

SEQ ID NO: 1945 - DNA, 61 bp, Homo Sapiens
aagtattataattcagcttcaaatctgaccytcctgacctgagaggcttggtacaccaggc

SEQ ID NO: 1946 - DNA, 61 bp, Homo Sapiens
aggccattaaaatgcaaatcaggtctgagcyttgaggtggccccacctctcccaagcatct

SEQ ID NO: 1947 - DNA, 61 bp, Homo Sapiens
ggtctgccctgagggcacttcttgacgattrattgggtacaaatccttatctccaaggcag

SEQ ID NO: 1948 - DNA, 61 bp, Homo Sapiens
cctccaggtccagagtgttctagaaatggaygagaaagcaaagtgagcaaacagaagctga

SEQ ID NO: 1949 - DNA, 61 bp, Homo Sapiens
gtcacaggggaaggcaggtgttccataaacygctacagagacagcaaagcactggctgaga

SEQ ID NO: 1950 - DNA, 61 bp, Homo Sapiens
acaaagctactactctggaaagcagaacccrgctggtaggatcccagaatctgtgcaatta

SEQ ID NO: 1951 - DNA, 61 bp, Homo Sapiens
aaggatttctttggtgttcaccactgtatcyccagaacctcaaaatgtacatagcacacag

SEQ ID NO: 1952 - DNA, 61 bp, Homo Sapiens
cacgcgcacacacacatgcaaaatccacacrttctccaaaccccttttctatttaccttga

SEQ ID NO: 1953 - DNA, 61 bp, Homo Sapiens
tcctctcatttaatcctcccaacaagctggrggaagtagtatcactgtccctctgcaaaag

SEQ ID NO: 1954 - DNA, 61 bp, Homo Sapiens
aacagcaataaatgagaaaattagttttccrttaaagcagtacatatggcttagattctta

SEQ ID NO: 1955 - DNA, 61 bp, Homo Sapiens
tgtgccccctagggccctgtcatgccatcayagagtaggtcaaattgtgttcccccaaaaa

SEQ ID NO: 1956 - DNA, 61 bp, Homo Sapiens
ttgcctagctggggctttgtgtgttcagacwcaccggacaatggtgttggctctgtagatg

SEQ ID NO: 1957 - DNA, 61 bp, Homo Sapiens
ggtacagttgctagaaagccattctcaaacrgtgttcaaccccttcctagctatgagactt

SEQ ID NO: 1958 - DNA, 61 bp, Homo Sapiens
ttacatatgggacgctcaggggccagagaasgttgctgtcttgcccatagccctgccggta

SEQ ID NO: 1959 - DNA, 61 bp, Homo Sapiens
caacactgcccagcatggcccctctcacccmagaggactttccttgttcacactctcattt

SEQ ID NO: 1960 - DNA, 61 bp, Homo Sapiens
attccccatttttagaatattgatatacagraataccaagaggataaaatgagacagccaa

SEQ ID NO: 1961 - DNA, 61 bp, Homo Sapiens
gagggcagaaaggatttcaagctggtcattrttatcattattatttattgcctgtttaaaa

SEQ ID NO: 1962 - DNA, 61 bp, Homo Sapiens
gagccctctatgactatcttggcccaaacgyttcattttattaataggggcactgaggccc

SEQ ID NO: 1963 - DNA, 61 bp, Homo Sapiens
gcaggtcaccccattccctatgtcctgtgayctacaaggtgactgtgcttgtcgggacccc

SEQ ID NO: 1964 - DNA, 61 bp, Homo Sapiens
gaatgtgttgctgatgtggagttttgaacaygagtaggagccactcagatcaagaagggag

SEQ ID NO: 1965 - DNA, 61 bp, Homo Sapiens
ccagttctattcacaactgtatgaatataawcatcttcaaatgagaaagttaaaaggaagg

SEQ ID NO: 1966 - DNA, 61 bp, Homo Sapiens
ggaggaagaatgtctgcatggctggaatgcrtgagtgaggaaaggagcccaggaagtgagg

SEQ ID NO: 1967 - DNA, 61 bp, Homo Sapiens
agccatcttaaacaaagcagaatttgaatgycaatacactaactcacttcacacacgaaga

SEQ ID NO: 1968 - DNA, 61 bp, Homo Sapiens
acataaaataaagtgtctcttaaaatgaatsgcatcttgatgtgataaaatatagcatgtg

SEQ ID NO: 1969 - DNA, 61 bp, Homo Sapiens
agaactagaatggtccttagagatgatgaartttaattccctcatttcacaaaagggggaa

SEQ ID NO: 1970 - DNA, 61 bp, Homo Sapiens
aaagggaggcaattcatggcaaccatagtasagtggtctgcaagggttacaaatgagaagt

SEQ ID NO: 1971 - DNA, 61 bp, Homo Sapiens
tggaagtctgaaaacccgagggctggaaagraccattcagatctacagagtattttacagc

SEQ ID NO: 1972 - DNA, 61 bp, Homo Sapiens
gggggctcaaagatacttaatgaatgaatgrctagcacttccagctctacaggtctcctgc

SEQ ID NO: 1973 - DNA, 61 bp, Homo Sapiens
attggaatctgcaacagcctcctcatggatytccttgattctactcttacattctcacagt

SEQ ID NO: 1974 - DNA, 61 bp, Homo Sapiens
aaatatacaaaatgggatgagaattttgggragactagcagagactacttagggttatcaa

SEQ ID NO: 1975 - DNA, 61 bp, Homo Sapiens
tgtcaccattggaagagaaggctcaaaaatwtacctttcattgtgtgttatatgaaatata

SEQ ID NO: 1976 - DNA, 61 bp, Homo Sapiens
ctgacttgctttctggaacaacaagatattmctggtataactttaattttccttgttgtag

SEQ ID NO: 1977 - DNA, 61 bp, Homo Sapiens
tttcattcctggcttccttgcatattctttkatagacctctgtaagagaacattcaaactc

SEQ ID NO: 1978 - DNA, 61 bp, Homo Sapiens
gttggcatgtaggctcggttaatggctgccrtctttgatttagtccaacctgttagatgaa

SEQ ID NO: 1979 - DNA, 61 bp, Homo Sapiens
aacatgtgacagacttctctaggatttttcraaaggagactcagggaagagaactatttct

SEQ ID NO: 1980 - DNA, 61 bp, Homo Sapiens
tgtgattctccatgagggtgatacatacacrattttcaccaacttatttttctttgggagc

SEQ ID NO: 1981 - DNA, 61 bp, Homo Sapiens
tccaaatccctaacctctgctttctggatastgtttgttttagtttcagctgcaatcattc

SEQ ID NO: 1982 - DNA, 61 bp, Homo Sapiens
tctaataattagtataatgcctgataaaggrtaggcaactcaattattgaatgaatgaatg

SEQ ID NO: 1983 - DNA, 61 bp, Homo Sapiens
cttctaatggggccctattttgtactctcarcatctgagtgatatctgaatcccactgatt

SEQ ID NO: 1984 - DNA, 61 bp, Homo Sapiens
agtcagcaggacaaatggaatcctaaggaascttaaacctaattcatggcttctgtttacc

SEQ ID NO: 1985 - DNA, 61 bp, Homo Sapiens
cagttctccatttaaaggcttagctttgaartggaattggcagggacctcatggagatttt

SEQ ID NO: 1986 - DNA, 61 bp, Homo Sapiens
atatcctaactctcccctccacaaacagtcrtccctattatttacatcttgtgttagtgtg

SEQ ID NO: 1987 - DNA, 61 bp, Homo Sapiens
ggccttctttccactgactgccagatgagcytgcgtttcatgttatctctgtagaacattt

SEQ ID NO: 1988 - DNA, 61 bp, Homo Sapiens
tatggtttcaactaactcttgcagttttaakgggatgacagtcatatctaacatttagaga

SEQ ID NO: 1989 - DNA, 61 bp, Homo Sapiens
ctatgccaagggctttataaatcatgtaaawctcataataacgtatgaagtcaaattgtta

SEQ ID NO: 1990 - DNA, 61 bp, Homo Sapiens
gaacatcctagagtcctcgtggatgaagcaytgaatacgcaccaagtcaagccccagaagc

SEQ ID NO: 1991 - DNA, 61 bp, Homo Sapiens
cctaaagttctccttggctcctcctcgctcscatctagaacccgcctaggaggtaatcact

SEQ ID NO: 1992 - DNA, 61 bp, Homo Sapiens
agtagaaacacagtgatgaactgtaaggttwtcataggccagtggtggcaggaaagatttg

SEQ ID NO: 1993 - DNA, 61 bp, Homo Sapiens
ttttcagatgggaaaactgaggctaagagtrgttaagccagttgtctgaggtctcatggcc

SEQ ID NO: 1994 - DNA, 61 bp, Homo Sapiens
tctcccacaaatccatgacaagtactaggcrcactagggtttatcctcccacacatatttt

SEQ ID NO: 1995 - DNA, 61 bp, Homo Sapiens
ctgtggcatcgcctctcagggcaccaggatkcacgcacagggtggatgtagcctttctact

SEQ ID NO: 1996 - DNA, 61 bp, Homo Sapiens
agtaaaatatctgtaggtgttctggttgctycacacccatgaacagcaatgcccagaggaa

SEQ ID NO: 1997 - DNA, 61 bp, Homo Sapiens
aaatttatgcaaaggttccaaactacatccyaacagcagtggttcgttcctgagccccacg

SEQ ID NO: 1998 - DNA, 61 bp, Homo Sapiens
taataatgtggaaaagtctatgttccaatcmccggcatgtggaatatgggatggggcaaac

SEQ ID NO: 1999 - DNA, 61 bp, Homo Sapiens
accctggggctcaacaacttcatgaaagggkctctggaagcactggggagcctgccccctc

SEQ ID NO: 2000 - DNA, 61 bp, Homo Sapiens
ctaaaaggtcaagagaaattgaaagtaacckcactctcctaacaacagccttctctcttgg

SEQ ID NO: 2001 - DNA, 61 bp, Homo Sapiens
gtaaatgtttaaactatactgtaattgttakcaccttgcttaggcctgttttcaattttat

SEQ ID NO: 2002 - DNA, 61 bp, Homo Sapiens
gggctgcgtgacaagcggcgtgtgcatagtyctggggtagcacgaggacagaagcaactca

SEQ ID NO: 2003 - DNA, 61 bp, Homo Sapiens
ccagcaacgccgttccagtgtgcctcctcaygtgtacgatgggtaaaatgatttcttcctc

SEQ ID NO: 2004 - DNA, 61 bp, Homo Sapiens
cttttgttccttctttctatagtttattgayggtcgattagatcttctcaattccggcgaa

SEQ ID NO: 2005 - DNA, 61 bp, Homo Sapiens
gtgacagggcagtggaggcgagaccgcaacstacagcaagaagaaaaggaacctccacgaa

SEQ ID NO: 2006 - DNA, 61 bp, Homo Sapiens
caggtgctcaggggagatcaacgtcctttgyggctcttttgagatgccctttgtgagctgg

SEQ ID NO: 2007 - DNA, 61 bp, Homo Sapiens
cgtatatgagagatgatctcctccagctgawaaaggggtcacgatggtgtggagaacccag

SEQ ID NO: 2008 - DNA, 61 bp, Homo Sapiens
aagcagtgatccacttaattaagaactttgygtggatcattactaactgcgacagagtgcc

SEQ ID NO: 2009 - DNA, 61 bp, Homo Sapiens
gctgtgctaactccagccatgatactacatstttctgtatcttgctttcttcctaagagct

SEQ ID NO: 2010 - DNA, 61 bp, Homo Sapiens
tacagtaactcagttttaagtatgtttttgmcacgagacggggtcctgttaggtgaagctg

SEQ ID NO: 2011 - DNA, 61 bp, Homo Sapiens
tttgctcaattatgtttgaaagggtcttccrtgttgtgtgtaactgcagtcatagattttc

SEQ ID NO: 2012 - DNA, 61 bp, Homo Sapiens
aatgaaaggtgatgatatcaaggtttccaayttgggcctcataatacccttcatagacact

SEQ ID NO: 2013 - DNA, 61 bp, Homo Sapiens
tcttatgtttgtcttatatgtaatgtgcagrgttttttgttatttctaatgtagattttct

SEQ ID NO: 2014 - DNA, 61 bp, Homo Sapiens
tggaaaatgtgaagtgctaggctctgagctygatgaacaattggtattgatattatttcag

SEQ ID NO: 2015 - DNA, 61 bp, Homo Sapiens
ctctgccaagactccctggcctcagtccagytctgggggtgctgactgcagagcagtggtt

SEQ ID NO: 2016 - DNA, 61 bp, Homo Sapiens
cactgtgtcgcccaggctggagagcagaggygaaatcatagctcaccgccacctcaaactc

SEQ ID NO: 2017 - DNA, 61 bp, Homo Sapiens
ctgttcctagtttctggcttttaaactggcrgttttgaggctgtggggaccaggtgcctgc

SEQ ID NO: 2018 - DNA, 61 bp, Homo Sapiens
acatttgccacaggtagacttcggaaggtgwcaggccttagagccacagtggccgcacaac

SEQ ID NO: 2019 - DNA, 61 bp, Homo Sapiens
gtttacagtcccatcgctggtaatacagagrttgccttcatccccaaagcctagctaagag

SEQ ID NO: 2020 - DNA, 61 bp, Homo Sapiens
ttgcattgagactacaatttccttggtctcrggtcttatcttttggtttttctcctaatag

SEQ ID NO: 2021 - DNA, 61 bp, Homo Sapiens
tagagaaaaacaggagcaagataagaacaaygtactgaaaaggaaattggatgagggcctg

SEQ ID NO: 2022 - DNA, 61 bp, Homo Sapiens
ttaagaaataactttagagtgagaaacctawatgtgaaggtcattttcccctcactccagg

SEQ ID NO: 2023 - DNA, 61 bp, Homo Sapiens
cacttactaacagtatgaccgcagacaccarcaaaacgtcccactgctgcttatttccaag

SEQ ID NO: 2024 - DNA, 61 bp, Homo Sapiens
aagacatttatagatttgtataactaccatygccaccacaggacataaaatatttccataa

SEQ ID NO: 2025 - DNA, 61 bp, Homo Sapiens
aattcctggtatcctcggctgaactggctaktgtcggtatttttaattttagccattctag

SEQ ID NO: 2026 - DNA, 61 bp, Homo Sapiens
aacctggttgaaatgtggctagtccccttaygcttgggtcacagaccaatttgggttaact

SEQ ID NO: 2027 - DNA, 61 bp, Homo Sapiens
ttcttttagtcttagagaaagagaggaaaayattaaccattggtttaccaattcaaagtta

SEQ ID NO: 2028 - DNA, 61 bp, Homo Sapiens
aactcattaacaggctccgataatgagaccrtcggaaaagcccaagagcttgcctgtctag

SEQ ID NO: 2029 - DNA, 61 bp, Homo Sapiens
agcgtttcagacccagacagtatgtctcccrcatggcatagagaatggcttgatgacttat

SEQ ID NO: 2030 - DNA, 61 bp, Homo Sapiens
agtaaacgtatgttgacagacttttcaaatmatcatctttgttattacaccaaaatttgat

SEQ ID NO: 2031 - DNA, 61 bp, Homo Sapiens
tctaaggcaagggtaaaattaggatctacgytagatgagatcctgtagactgcccagccac

SEQ ID NO: 2032 - DNA, 61 bp, Homo Sapiens
ttgccgcaaatgtgactctgagaaggactckgaagaggtgacacgaggtcctgagggtagg

SEQ ID NO: 2033 - DNA, 61 bp, Homo Sapiens
tgcactgctctgcctcctggctgtgcctccyatctgatgatgacaccagaccagaagcaag

SEQ ID NO: 2034 - DNA, 61 bp, Homo Sapiens
ggtgaagacaagagtagcagcagccaatggytttcagtgccccgcaagccctgtgcagtgc

SEQ ID NO: 2035 - DNA, 61 bp, Homo Sapiens
tgacaagcgaccatcgagtagtgataattayaaaacatgtgcaatcacagcttcacattca

SEQ ID NO: 2036 - DNA, 61 bp, Homo Sapiens
ctctgagtgtctgccccactgggaatgaaaygttgggattctagtctggaaggttctccca

SEQ ID NO: 2037 - DNA, 61 bp, Homo Sapiens
cccagatagctgtgtggcaggccccaggctstacgggacacagtggacagacaggcccagc

SEQ ID NO: 2038 - DNA, 61 bp, Homo Sapiens
atggcagaaaactcaacgcttcctttgcacratgattaaaaagtcagagctgcttgagatg

SEQ ID NO: 2039 - DNA, 61 bp, Homo Sapiens
tcttttaacgggagatttaggagagactcayagaaagaggatcaaaggtcaggagactggg

SEQ ID NO: 2040 - DNA, 61 bp, Homo Sapiens
ctgccgtgccgcgtgtccgtcccggaagacragcgctcaggtctggggctgcacggacact

SEQ ID NO: 2041 - DNA, 61 bp, Homo Sapiens
cagctacacctcccacagccgccatgactcygtagccaactcaaaagaaggcgcaacaatt

SEQ ID NO: 2042 - DNA, 61 bp, Homo Sapiens
gccatgagcatgaggaggcaggcagcacttyatgttccaacttcctttcctttggataaac

SEQ ID NO: 2043 - DNA, 61 bp, Homo Sapiens
gataagggatcagcctaagtgcttgtcaacrgatgaaaggatacagaaaatatggtgtata

SEQ ID NO: 2044 - DNA, 61 bp, Homo Sapiens
agcgtgaactcaccgtgagtcgctctgctaygatattccatccatggcttcatgataacta

SEQ ID NO: 2045 - DNA, 61 bp, Homo Sapiens
acagctcatttgttttaagcgttggattaayagtctgtcttttgggcataccacagtttat

SEQ ID NO: 2046 - DNA, 61 bp, Homo Sapiens
ttagaattactgatgaggttccatgtcccaytaggcactcattgtcttgataaacatctta

SEQ ID NO: 2047 - DNA, 61 bp, Homo Sapiens
tcagtgccactcaacctgcatgactaagaaygtagtcttcagtgtttcactgaatgtgaga

SEQ ID NO: 2048 - DNA, 61 bp, Homo Sapiens
aaatatgtatctcttactgtgcttttctacrtctagacatgtttagatacacaattgcctg

SEQ ID NO: 2049 - DNA, 61 bp, Homo Sapiens
ctgataaagcacatttctaggaacagggccratttcctctgccttccactgtgaacggtaa

SEQ ID NO: 2050 - DNA, 61 bp, Homo Sapiens
catagtgaaaatgagtctaaagaaaaatgarctattcttcaaccattatttttatttgtct

SEQ ID NO: 2051 - DNA, 61 bp, Homo Sapiens
cagaggtaacagtgaatccaggatgctgctrtcagcctgtgcattgtgaagaaggcaatca

SEQ ID NO: 2052 - DNA, 61 bp, Homo Sapiens
ccacctgtgggttgcagaagggtaacctacrgatgcccgattgtcctttttccctggatta

SEQ ID NO: 2053 - DNA, 61 bp, Homo Sapiens
atgtgctcatacgtcatgtcgaaagtaccasaaactggaaaaggaatcaattccttttttt

SEQ ID NO: 2054 - DNA, 61 bp, Homo Sapiens
caagtagagaaatcatctgtgaacatcgcaytgtatatttataaaactgtttgcacaaagg

SEQ ID NO: 2055 - DNA, 61 bp, Homo Sapiens
ctgtccctctctgaaagaatcactagaaagrcttctcgtagatgtactgaattttccatgg

SEQ ID NO: 2056 - DNA, 61 bp, Homo Sapiens
ctttactgtgagcaagtatttttttcaagcrtcagcagatgagtgaaacagaatatgcttt

SEQ ID NO: 2057 - DNA, 61 bp, Homo Sapiens
taatgatcattttcatcgtttccaaaggtcycatctattattctcctcactcattgccaga

SEQ ID NO: 2058 - DNA, 61 bp, Homo Sapiens
cctgggcaacgttgcagccaaagatgtataygtttccactctttctttgtttttttttgag

SEQ ID NO: 2059 - DNA, 61 bp, Homo Sapiens
catgctgcttgagttgagattcaaggaaaamcatttctgaagagttttctgagactcttgc

SEQ ID NO: 2060 - DNA, 61 bp, Homo Sapiens
gtctgtagcatttcttgagatgagcaagaaractgtagacaacagtaacttgaaacttcag

SEQ ID NO: 2061 - DNA, 61 bp, Homo Sapiens
ttgaagtcaaaagtattatcagaatttgtcrtcgattcttaaggttgtatctactaataca

SEQ ID NO: 2062 - DNA, 61 bp, Homo Sapiens
tggagatcacagaacagatgaactgaatgcmattttctcggagttcaactagatattctaa

SEQ ID NO: 2063 - DNA, 61 bp, Homo Sapiens
cttgccaaaaatacacagtctcaatctaatygtcagcaactgttgacaaacccaaactgag

SEQ ID NO: 2064 - DNA, 61 bp, Homo Sapiens
ttgacaagaccatcaacatcagacaataaarggcagtgaccactgagagacgggaaacaag

SEQ ID NO: 2065 - DNA, 61 bp, Homo Sapiens
gagctccctctcagccttttgaactgattaygctgttattaaactttggtggggaaagtta

SEQ ID NO: 2066 - DNA, 61 bp, Homo Sapiens
cttttaggcttttgtgaagctgagtccagtrgaaggagtccagaagcagagctatgggaag

SEQ ID NO: 2067 - DNA, 61 bp, Homo Sapiens
cagaaactgagttgtggtccatgagtataarcttaacaatagacactgtagcaaattgaat

SEQ ID NO: 2068 - DNA, 61 bp, Homo Sapiens
ccagttgtaatcaaggattccatcttttccyaattccaagacagataaatcattactcatc

SEQ ID NO: 2069 - DNA, 61 bp, Homo Sapiens
aggcacagaggataaagatggataaagaagygaaacctaatggtatgctaagagacccatc

SEQ ID NO: 2070 - DNA, 61 bp, Homo Sapiens
aacaatggtggcttaaagatcagtgtagtarcaatggaagttttgctttagaaatagacat

SEQ ID NO: 2071 - DNA, 61 bp, Homo Sapiens
aaaagattgaaaaactggaatagaagatctragaattgtggaataactaaaaaaggtatga

SEQ ID NO: 2072 - DNA, 61 bp, Homo Sapiens
ctagttctcaaaaccatttgttctgctttcmtaattgtgtaagcttctccttcaggccctt

SEQ ID NO: 2073 - DNA, 61 bp, Homo Sapiens
atccaagccactgttatctctcacctagacsattgcagtagctcctgagtttttccatctt

SEQ ID NO: 2074 - DNA, 61 bp, Homo Sapiens
gtggaagaaacagaatcattacagatgagcraggcttaaggtgtttgctttgtaacaacac

SEQ ID NO: 2075 - DNA, 61 bp, Homo Sapiens
cgataactgcacttggacccttccttagtgygagaggtgtggcccagacatctccaacttc

SEQ ID NO: 2076 - DNA, 61 bp, Homo Sapiens
cgcctctgcctttcttgtaactgcattccartggaactttctccctctgcctggtccagct

SEQ ID NO: 2077 - DNA, 61 bp, Homo Sapiens
aaacggcccatcttttagagtccgacctctrgaaatgtgtgtatgatgtgatgtgtgtgtt

SEQ ID NO: 2078 - DNA, 61 bp, Homo Sapiens
attggattgattcagctctgggggaacaagycctaataaaataacagtagacctcaaaaat

SEQ ID NO: 2079 - DNA, 61 bp, Homo Sapiens
atagtcatgaggaaattaaaactgtttgccraattcagacctataattagcatttgataca

SEQ ID NO: 2080 - DNA, 61 bp, Homo Sapiens
ttagtaaatttgcagctgtacacagggttgytgaatcatgttaggtggaagtatgaccttg

SEQ ID NO: 2081 - DNA, 61 bp, Homo Sapiens
tgttaacttcacatcatagtatttaagctaygggatatcaatgaggtgagtaaacatcacc

SEQ ID NO: 2082 - DNA, 61 bp, Homo Sapiens
aagtatactaatattttccccattgcttcaygataattttaataaattttctttatcttcc

SEQ ID NO: 2083 - DNA, 61 bp, Homo Sapiens
aaatggctaaaatacctgcatgtctgcctamaaaccttactgtttctttaattcggttccc

SEQ ID NO: 2084 - DNA, 61 bp, Homo Sapiens
tactaacgttttaaagatgtaaattccactmagcaaagaacaccctaaaattttgaccttg

SEQ ID NO: 2085 - DNA, 61 bp, Homo Sapiens
ggtgggtgtggtagatattttatgacattayttgggcaaaatatctgactaattatttctc

SEQ ID NO: 2086 - DNA, 61 bp, Homo Sapiens
tgctctactatcacaagcttttaaattttgyctgcaatgtttcattttgcttttaagcacc

SEQ ID NO: 2087 - DNA, 61 bp, Homo Sapiens
aactttccaaggcttacgttgcactctggcrgctctacggttatggcgtcacagatgcagc

SEQ ID NO: 2088 - DNA, 61 bp, Homo Sapiens
aaagtcactgggaacatctttattctcaaamctttaagagcctgttattagagatgtgatg

SEQ ID NO: 2089 - DNA, 61 bp, Homo Sapiens
gaaaatggcatcatgatttgcttgtaaaacrtcctttcaataaaatgtatcaagtgtctac

SEQ ID NO: 2090 - DNA, 61 bp, Homo Sapiens
tgttcataactgaaatgaatcagaaaagtcracttatgtaatacattagcaatacttattt

SEQ ID NO: 2091 - DNA, 61 bp, Homo Sapiens
cagttattattgtccatattttacagccaakaatatttcagaaaaacaaaaaataagttca

SEQ ID NO: 2092 - DNA, 61 bp, Homo Sapiens
aggagtatgtaagcctccagaaaatttccayaggttccatgggaggtcccatctaataggt

SEQ ID NO: 2093 - DNA, 61 bp, Homo Sapiens
cattttattgtcagaatggtgcaaattgagractttagcatgatttcgactgtgtgtactc

SEQ ID NO: 2094 - DNA, 61 bp, Homo Sapiens
atcaaaatgttaataaaagtctcagattttyctttagcagacaattcattgccattgaatt

SEQ ID NO: 2095 - DNA, 61 bp, Homo Sapiens
taaaatgtcttagggagggatgactgtgaawaacctgtgctccatgaatcaatgaacatat

SEQ ID NO: 2096 - DNA, 61 bp, Homo Sapiens
tttgaacattttacaatgtttggtcttgctsttgtactcttacaatgacctttgcagacaa

SEQ ID NO: 2097 - DNA, 61 bp, Homo Sapiens
gagatattcaagaggatttcaaaggtatcargaagggattctatgagtgactgagtgggaa

SEQ ID NO: 2098 - DNA, 61 bp, Homo Sapiens
gaagaaacacattttttgacgcagtcataartagctttagttgtgccataacaaaggtgtg

SEQ ID NO: 2099 - DNA, 61 bp, Homo Sapiens
taacaaaggtgtgacattttttctaggcatygaatttatgtggaaatctatttgctacatt

SEQ ID NO: 2100 - DNA, 61 bp, Homo Sapiens
ataactttggaaactcacaacttcaaaaaartgttcgctgttgtggaaagtttccgcagta

SEQ ID NO: 2101 - DNA, 61 bp, Homo Sapiens
atgttaggatatgcaatatttaatattggaytgggtttgtcatctgaagactgaataagtt

SEQ ID NO: 2102 - DNA, 61 bp, Homo Sapiens
tatttggagtttttcagaatggctagtgaaytccttggtgatttattggtaaaaaaataaa

SEQ ID NO: 2103 - DNA, 61 bp, Homo Sapiens
atgtatcagatactcttggagagctctgtgycactcacttcttcatcagggcactcctgcc

SEQ ID NO: 2104 - DNA, 61 bp, Homo Sapiens
gtattataaattttatgtaaaaagtaggccracagcaaaatgaacagcataatccaattta

SEQ ID NO: 2105 - DNA, 61 bp, Homo Sapiens
aagtttgaaatttaccaaatgatcttcaggyctctcaaagtatcaaaaaactcaccatatc

SEQ ID NO: 2106 - DNA, 61 bp, Homo Sapiens
attatcttcatcacttttctacattgacagmctgtggaaaaattatcagcctaatattttg

SEQ ID NO: 2107 - DNA, 61 bp, Homo Sapiens
atggttagccactgtcatcatttagagtaawagattatggacttgtatgatttcatagcat

SEQ ID NO: 2108 - DNA, 61 bp, Homo Sapiens
gcctttctgtgcctagcttgtttcactaagmataaagacctccaggttcattcattttttt

SEQ ID NO: 2109 - DNA, 61 bp, Homo Sapiens
taatattccgttgtgtatacatactacgatrtctttgttgattcattcattgatagacact

SEQ ID NO: 2110 - DNA, 61 bp, Homo Sapiens
agcaaagacttcatgactaaagcaagaaaarcatttgcaacaaaagccaaaattgacaaac

SEQ ID NO: 2111 - DNA, 61 bp, Homo Sapiens
gtaacttgttttaggctgaagtggaagtatytgcagcatcacaattgtcaaagtctacaaa

SEQ ID NO: 2112 - DNA, 61 bp, Homo Sapiens
taataactcagcatatacttcacactaagcyaataaggtatgcttactgttttgatgtgtt

SEQ ID NO: 2113 - DNA, 61 bp, Homo Sapiens
gcttcacgatgaaccgttcactttcactctrttcaccacctcactgaatactcttagttta

SEQ ID NO: 2114 - DNA, 61 bp, Homo Sapiens
aaagctcttcaaggttctattcttggttttyttaatactagtagcaatagctgacgcttat

SEQ ID NO: 2115 - DNA, 61 bp, Homo Sapiens
acagatatgaccaagatgaaagggttgtggrgtacatgaaggtcttggtgaagtcggtggt

SEQ ID NO: 2116 - DNA, 61 bp, Homo Sapiens
ctcacacacaggatttcagtttggggcttawgtaagaaactagcaagttatgtgaactata

SEQ ID NO: 2117 - DNA, 61 bp, Homo Sapiens
attccaggcagtgcagctcagggactctttycacttggagaaaggagagggaagaatacag

SEQ ID NO: 2118 - DNA, 61 bp, Homo Sapiens
gttagtccattcaaacttggcctctcatcartggggataattttagatatttcgttaatga

SEQ ID NO: 2119 - DNA, 61 bp, Homo Sapiens
tcaaaaggtcaagtggagcaagtcacatcayggtccactactctgcagaaaggactggtgc

SEQ ID NO: 2120 - DNA, 61 bp, Homo Sapiens
atattccatatattgtatggacttggatttkcacatggcaagggcaaattccatccatata

SEQ ID NO: 2121 - DNA, 61 bp, Homo Sapiens
attcaaggcgttattacatgtctgttctgayagatcaaaaagtaacataaaataatcaacg

SEQ ID NO: 2122 - DNA, 61 bp, Homo Sapiens
aatacatacaagaagaagccctgtactcaastcatctcccacaaatgaataaatgcatgta

SEQ ID NO: 2123 - DNA, 61 bp, Homo Sapiens
gtcttgacatgacttttagattaatttttgkatcctatggtctcatcaatacagagcctca

SEQ ID NO: 2124 - DNA, 61 bp, Homo Sapiens
ctacaaaattatatgtgaaactgcacaattrgaattacatttccaatacattcgcttacat

SEQ ID NO: 2125 - DNA, 61 bp, Homo Sapiens
aggatgccaaggacagaataactgtgttggsatacgttaatacaatatgcatacataaatg

SEQ ID NO: 2126 - DNA, 61 bp, Homo Sapiens
gaactaaaactggctctcagtttacaccatsactaacaagaaagctttacataatccagag

SEQ ID NO: 2127 - DNA, 61 bp, Homo Sapiens
atacattaatttatataccgttttatagttkataaggcatattcatgtatattatttttct

SEQ ID NO: 2128 - DNA, 61 bp, Homo Sapiens
taatgtgttaatgacaatagcaatttaaatrttgtagcacacacagcaaagggaattagaa

SEQ ID NO: 2129 - DNA, 61 bp, Homo Sapiens
ggaacatctggattagaaaggcccatagcartagacaaggcttttccaagtaaaattccat

SEQ ID NO: 2130 - DNA, 61 bp, Homo Sapiens
cattgttacttggcaatctcttggaagattwttgttagtcacaagtgatgtgagaggtgtg

SEQ ID NO: 2131 - DNA, 61 bp, Homo Sapiens
aactagaattcttaatgtaagaagagatacygaactggaatgaaaaatgataagaaaatat

SEQ ID NO: 2132 - DNA, 61 bp, Homo Sapiens
tccaggtgttttatgcatctgtagtatcatstctttgtttgtagaacaacagatgactctc

SEQ ID NO: 2133 - DNA, 61 bp, Homo Sapiens
atatgagcttttgagaagactggcattaggrctcattgggtttttagaaatgatgactaac

SEQ ID NO: 2134 - DNA, 61 bp, Homo Sapiens
aaactgataaattccattctacattccatartcttaaaagtgctataatagaagtatgaat

SEQ ID NO: 2135 - DNA, 61 bp, Homo Sapiens
aatcccatacagtaaatatctcttctatgayggacctagacacatgttttgttttataaaa

SEQ ID NO: 2136 - DNA, 61 bp, Homo Sapiens
agttatcaatgctttggaacaaaattcaaayagcctagcatgtatgaaaatgtcaaaataa

SEQ ID NO: 2137 - DNA, 61 bp, Homo Sapiens
tgtgctttgttaactgtaacttattcttggmtccctgaaatgtcacacaaaaagcccgact

SEQ ID NO: 2138 - DNA, 61 bp, Homo Sapiens
taagctgttctgaactttggagtgtagattkatcaaacaaaggcggccttttggtcaacac

SEQ ID NO: 2139 - DNA, 61 bp, Homo Sapiens
aggtcacatatcttagttaccgctcaggaartaacctgtcagcacatcatctctgaacaca

SEQ ID NO: 2140 - DNA, 61 bp, Homo Sapiens
tcttaacttatttacccataagtacttatcygtaaaaaatatggcatgccatttacacagt

SEQ ID NO: 2141 - DNA, 61 bp, Homo Sapiens
ctaaataaaaagccgctatttaaccatttgygattatgctatcatcccacaccatcgcatg

SEQ ID NO: 2142 - DNA, 61 bp, Homo Sapiens
cacaccatcgcatgtaaatgcacttttctaytctctttccagttgctaaagtaaatgacca

SEQ ID NO: 2143 - DNA, 61 bp, Homo Sapiens
ggtaagtgcaagactagtaacacatgtcttyagccttatcaataatattatcaataatatc

SEQ ID NO: 2144 - DNA, 61 bp, Homo Sapiens
ttagattttaaaagtcaggcttctctatgtkctcaaatgaatctgacttactttataagaa

SEQ ID NO: 2145 - DNA, 61 bp, Homo Sapiens
aaaaaaggttaaaaaaaccacaaacactatratggagaaggcaattctgcatagtgctatg

SEQ ID NO: 2146 - DNA, 61 bp, Homo Sapiens
aacataacaacctgcatgggctctttacacrccttcaaacatagctcatgatccctgtaat

SEQ ID NO: 2147 - DNA, 61 bp, Homo Sapiens
ataacttccagctatttccagctattagaamctgacacggtatttttaaggtttccattag

SEQ ID NO: 2148 - DNA, 61 bp, Homo Sapiens
atgcaatgctgcttttgttatcttatttaaycattaccaaccattttgtggggtattatca

SEQ ID NO: 2149 - DNA, 61 bp, Homo Sapiens
catctccccatttcccacaccctctcatctktggcaactgctgcttcactctgtttttatg

SEQ ID NO: 2150 - DNA, 61 bp, Homo Sapiens
ttactattcttttatacagagattgtgaaartaggagaatccttcaaagtttatcatatta

SEQ ID NO: 2151 - DNA, 61 bp, Homo Sapiens
ataaaagtttaagctgttgccagtcacgaasgtcttactttatcaggtccttttccctaac

SEQ ID NO: 2152 - DNA, 61 bp, Homo Sapiens
ttttgctttgctagttatgtaatgacatacwcaaaagttggtcagaaaaatgttaaaccaa

SEQ ID NO: 2153 - DNA, 61 bp, Homo Sapiens
tgcttagttcccatcacctgataagaactcrcctttaaacatgtgaaatggaggatataat

SEQ ID NO: 2154 - DNA, 61 bp, Homo Sapiens
tataagctgttattgatagtaaattaccackgctaaactactaataactgtggccattata

SEQ ID NO: 2155 - DNA, 61 bp, Homo Sapiens
gccaactctgagaacagagccaatctttgartatgtgcagaacatatgagggaggggagag

SEQ ID NO: 2156 - DNA, 61 bp, Homo Sapiens
acttccagcagtgactgatggtagaatatgrttatgactcctacttacgtattccagaatt

SEQ ID NO: 2157 - DNA, 61 bp, Homo Sapiens
acaaaagactttaaaacaaagcttccctccrgtggcctcattttattggatttcttgactt

SEQ ID NO: 2158 - DNA, 61 bp, Homo Sapiens
gctgaaacaagactagaaagggcaagctttstcaagttagaaaaagacccttttacgctag

SEQ ID NO: 2159 - DNA, 61 bp, Homo Sapiens
cttccttcttacagaaaaagtcaagctgcargataggattgtactttatacttccttcagg

SEQ ID NO: 2160 - DNA, 61 bp, Homo Sapiens
atgaaactcccatccttctgtagctatggtytttctctaaatattattactgaataataaa

SEQ ID NO: 2161 - DNA, 61 bp, Homo Sapiens
gaatttattttaaagcctcataacaaccacrctggatttttaaatttatatctagcctaaa

SEQ ID NO: 2162 - DNA, 61 bp, Homo Sapiens
ttacttttctcaaattgcccatcgacagaasttggcgcttctgtggcgctacgtgacaagg

SEQ ID NO: 2163 - DNA, 61 bp, Homo Sapiens
tatggaaaaggagccaacctgaggggtgacragactgagctgaggacactggttttctgcc

SEQ ID NO: 2164 - DNA, 61 bp, Homo Sapiens
aaacatttgctgaccatatacatttggttawttatgacttttccatttgcccagataaagg

SEQ ID NO: 2165 - DNA, 61 bp, Homo Sapiens
agaaatagaaagaaaagggattagttaggasgataaggtatgaagtatgatgtgctgagaa

SEQ ID NO: 2166 - DNA, 61 bp, Homo Sapiens
acagatgttacaagagaaagtaggagaaacsgacttttgatttaaaaagcctagactttta

SEQ ID NO: 2167 - DNA, 61 bp, Homo Sapiens
gttttaactaatttttaattaaagtatttgsttcacttatgttcatttatatatctgttta

SEQ ID NO: 2168 - DNA, 61 bp, Homo Sapiens
gaactccttacttcacctgtgtccttgggakttcaccagctgagctgaccagcagtctgag

SEQ ID NO: 2169 - DNA, 61 bp, Homo Sapiens
ggcaggatgtgattgtgccacctgggaatgsaacgtttttaattaggatttcccaacagat

SEQ ID NO: 2170 - DNA, 61 bp, Homo Sapiens
cctccagaaagactgccgatcaccacaggtyctgtccagcctccatccaccatggcagcca

SEQ ID NO: 2171 - DNA, 61 bp, Homo Sapiens
agagacttcctgcctccatgcttcctaataraatcttccccacattggaactcagaccccg

SEQ ID NO: 2172 - DNA, 61 bp, Homo Sapiens
tcaagggcttaaaggcaggaaccaaatgccrgcttgcctctttcaactcctagaaggtcag

SEQ ID NO: 2173 - DNA, 61 bp, Homo Sapiens
tgggaagatgggagaaaatggagactcagaygaacaggctttaaaactaatacatgaaaaa

SEQ ID NO: 2174 - DNA, 61 bp, Homo Sapiens
agttttaggtgacttcctcaaattccccaawcctaaattctatttgcttattttacttctg

SEQ ID NO: 2175 - DNA, 61 bp, Homo Sapiens
actgcagtgggatggtttcactcctcatttwctaaaacactgcatctgaaggtttctacaa

SEQ ID NO: 2176 - DNA, 61 bp, Homo Sapiens
ctagaatagtgctggggtgtaataaaccctyctctgtaagaatgtggtagtattattaaat

SEQ ID NO: 2177 - DNA, 61 bp, Homo Sapiens
gccagaaaaataagcccttcatcctgccttyagcgaggcgagccccacagcaagggccaaa

SEQ ID NO: 2178 - DNA, 61 bp, Homo Sapiens
aattttgtcattgagcaaacatcataaagtrcacttagacaaacctagattgtatagcctc

SEQ ID NO: 2179 - DNA, 61 bp, Homo Sapiens
tttggatgaaccatgggacccagatgcctawgaaaggggaggacttgtaatctttttattc

SEQ ID NO: 2180 - DNA, 61 bp, Homo Sapiens
ctgtgtgtgcaatatgtgtttccaccacttygtgaagttcagccaaatggcccttaagaaa

SEQ ID NO: 2181 - DNA, 61 bp, Homo Sapiens
acagcaagtgcttgctaaggggtgttactgkcagcttttctctgagtccaactcccatcac

SEQ ID NO: 2182 - DNA, 61 bp, Homo Sapiens
tccagatatcccaccttttcaagccaacccwctgtgtaacctctatgtattgatttaggat

SEQ ID NO: 2183 - DNA, 61 bp, Homo Sapiens
cacagactttcttggcaatctgatagcaacrggctaggaaaatagattaatttcaatcaat

SEQ ID NO: 2184 - DNA, 61 bp, Homo Sapiens
gacgagttgatggagataatggtagaatgtwgctgaggacgcttccagcagccctgacctg

SEQ ID NO: 2185 - DNA, 61 bp, Homo Sapiens
tctatttcctaccatgcttctgtgataaagygagaaataatatgccaaaatgccactagca

SEQ ID NO: 2186 - DNA, 61 bp, Homo Sapiens
tttgaaggacacagtagaaaattagagtatkgtggatgtcattcctcacctaaaggccttg

SEQ ID NO: 2187 - DNA, 61 bp, Homo Sapiens
tcatatttagtggcaaggcactgtagcttckgaagtcgggcttgtccatcgttaaagcctg

SEQ ID NO: 2188 - DNA, 61 bp, Homo Sapiens
cctggatctctaattcactacttgaataaarctagtcatttgctaccttaaacaggaaata

SEQ ID NO: 2189 - DNA, 61 bp, Homo Sapiens
ttaaaaatttgaatggaagggggtaaaggargtcatgaagtttttttgcatttttatttaa

SEQ ID NO: 2190 - DNA, 61 bp, Homo Sapiens
ggcctttgggtagtttctccctactcttacrgaattgcctttatctctactacactgttcc

SEQ ID NO: 2191 - DNA, 61 bp, Homo Sapiens
cctagggccaactgtttccaattgtgctaaygggcaggttccggaggcagtggacagagtc

SEQ ID NO: 2192 - DNA, 61 bp, Homo Sapiens
tcaaccgccttctagacatccacctgaatgyttctcaggcatcttaaactcaacgtgtccc

SEQ ID NO: 2193 - DNA, 61 bp, Homo Sapiens
aagaaaatgagaaatagttcttataagatgsggaaaaaaacagcactacttgggaagttta

SEQ ID NO: 2194 - DNA, 61 bp, Homo Sapiens
cttactggctatggaaacttgggcaaattaycttggtgtcttcatctgtaaaacagggtaa

SEQ ID NO: 2195 - DNA, 61 bp, Homo Sapiens
tttcttcataaacatctaccaacttgtccartgaaaataaaataattttaagatgaaaaac

SEQ ID NO: 2196 - DNA, 61 bp, Homo Sapiens
tacattctctgatgaacaagcatttagatcrtaacatggtaaagcctattaccagccaatg

SEQ ID NO: 2197 - DNA, 61 bp, Homo Sapiens
tgctaggaatagttatcatgattatattgcwtagtgctttcccaaagtgcatttatatgca

SEQ ID NO: 2198 - DNA, 61 bp, Homo Sapiens
taaataggtataagccaccactaactcagtstgctggaaagcttctcagctaaagtagttt

SEQ ID NO: 2199 - DNA, 61 bp, Homo Sapiens
agtagacaaggctgcaacatttaagggaggygtgaaatctgctgactctcccaagtcttaa

SEQ ID NO: 2200 - DNA, 61 bp, Homo Sapiens
aaaatggcctctcttttcctcttttccagcrtcctgtgtacctctctccagtggacacagc

SEQ ID NO: 2201 - DNA, 61 bp, Homo Sapiens
aactactttgtgatacacttgagatcattcrttgacatcagctgagaagatagctactctg

SEQ ID NO: 2202 - DNA, 61 bp, Homo Sapiens
tcacctcttctgcccaggagaacacacattmttaagggggaaggaaacatggctcatcttt

SEQ ID NO: 2203 - DNA, 61 bp, Homo Sapiens
ctccctgtctgaacaggcttcaggcctccartcaaacgccctcttctaaaccagcttcccc

SEQ ID NO: 2204 - DNA, 61 bp, Homo Sapiens
taaaatgaggcagccacagaaacactttctrtggaaatctctctcacacatccaatggcca

SEQ ID NO: 2205 - DNA, 61 bp, Homo Sapiens
tgcctgggccacacacctgcagcatagtgcyaaaggggaaaaagggaaataaatccagacc

SEQ ID NO: 2206 - DNA, 61 bp, Homo Sapiens
ctatgtggctagcataggcatcctcatagcwtggaggtcatagtgtaggcaggcttctaat

SEQ ID NO: 2207 - DNA, 61 bp, Homo Sapiens
atgtgagtttataaaatggaacaattagggrgtgatgtaagtgctgaacaaaagaaggaac

SEQ ID NO: 2208 - DNA, 61 bp, Homo Sapiens
tgaactcatgttttcacccaggtggatagcyttcattctccacaggtcctattaattcttt

SEQ ID NO: 2209 - DNA, 61 bp, Homo Sapiens
cagcttctgctgatggagaattttctcttcrgaagcttcacaagtcagaggttaccccttg

SEQ ID NO: 2210 - DNA, 61 bp, Homo Sapiens
ccaccaaagacaacagcagccgcctgcgacyttcctctgccatgaaaactgagatgagaga

SEQ ID NO: 2211 - DNA, 61 bp, Homo Sapiens
gtcattagggatgaatgccaccttgttgtamgtgctaggctgcaaagagtagagaaatggg

SEQ ID NO: 2212 - DNA, 61 bp, Homo Sapiens
tggggacaagaaaattggaggtggatactcwacaaagacagctccaactgattttataaga

SEQ ID NO: 2213 - DNA, 61 bp, Homo Sapiens
ttggattatgtgattttagaggctgaaaagwttcacaatgtgtaaatttcagcctgggtcc

SEQ ID NO: 2214 - DNA, 61 bp, Homo Sapiens
aaatgaggggtttgtgtctgatactcctgaytaagtatttttgagaatctatttgcatgct

SEQ ID NO: 2215 - DNA, 61 bp, Homo Sapiens
ttgctattttaccagctaatatgcttttgtgycatttattgctctgtatgtctgtgactgc

SEQ ID NO: 2216 - DNA, 61 bp, Homo Sapiens
atataattttcacatgcatgtcataaaatayaattcttcacttgcttttcccccccaacca

SEQ ID NO: 2217 - DNA, 61 bp, Homo Sapiens
tgttaggtaccttcacttatataagcccttwaatcacaccagcctacggactgattattca

SEQ ID NO: 2218 - DNA, 61 bp, Homo Sapiens
cagagacttttctgatgatttcaagtcctcrtaaacctagcagagaatggaccatgtgtac

SEQ ID NO: 2219 - DNA, 61 bp, Homo Sapiens
cattcttgaatatgaccttctgaattggatwgcttttgtattctagcacattttgttttgt

SEQ ID NO: 2220 - DNA, 61 bp, Homo Sapiens
aatatccatgttatgggagacagagaaaggytgaaaaattgttccagattaaaggaagctt

SEQ ID NO: 2221 - DNA, 61 bp, Homo Sapiens
aagattatataggtaggtattgaaataattwccattggattcctgtcagacatgcattagt

SEQ ID NO: 2222 - DNA, 61 bp, Homo Sapiens
aggaataataaatactctgaggcatagagamttcagaagctttgacatgcagacttccgtt

SEQ ID NO: 2223 - DNA, 61 bp, Homo Sapiens
aaaacccccttctaaagaggactaaaagaasacaacaattgtccttggattacaaaagttt

SEQ ID NO: 2224 - DNA, 61 bp, Homo Sapiens
aatcaggagtaaaatgaggattgccattcasacaaaatccagaactggtaggcaatgattc

SEQ ID NO: 2225 - DNA, 61 bp, Homo Sapiens
atttcatgtaatgccacctaattgagacacrataacatctgtaccttcttcctttcatagc

SEQ ID NO: 2226 - DNA, 61 bp, Homo Sapiens
ttagtgttctttccttgcactggaagctggracaattataggattaatttcctttgttttt

SEQ ID NO: 2227 - DNA, 61 bp, Homo Sapiens
tgactacatggaagcaagcatgcaagtgagsagaataatgcaaagttaagtatagtgttca

SEQ ID NO: 2228 - DNA, 61 bp, Homo Sapiens
tagtgtttgcatttaatttgctactgcttcygaaaaagaaaatgtatcttgagggtttatg

SEQ ID NO: 2229 - DNA, 61 bp, Homo Sapiens
aaggaatttgtggagactagagtgcaatgckcaaagcttacaactagtaaaagaagaagct

SEQ ID NO: 2230 - DNA, 61 bp, Homo Sapiens
attcactgcttttacctttcctctcctcacrttatacactgctgatgtcacaatttacaac

SEQ ID NO: 2231 - DNA, 61 bp, Homo Sapiens
ctataactttggtccaaagaaggtccaaaaygcgtatatactttggtgggaatctcactta

SEQ ID NO: 2232 - DNA, 61 bp, Homo Sapiens
tgaaatataattcatacaccatacattttakccatttagtgtatgattcagcagcttttac

SEQ ID NO: 2233 - DNA, 61 bp, Homo Sapiens
cactataaccacagactgggtaatttgtaaygagtagaaatgtatttcttagagttctgga

SEQ ID NO: 2234 - DNA, 61 bp, Homo Sapiens
tacaaatacagcatttctgtaactaattaastgtctcctggaaatgcacttatgagactga

SEQ ID NO: 2235 - DNA, 61 bp, Homo Sapiens
actcaagtataacaaatgggaagtacaaatrcagcatttctgtaactaattaactgtctcc

SEQ ID NO: 2236 - DNA, 61 bp, Homo Sapiens
tgttttctttgttctacttaaggaaacgtcyatttgatggttacaaaaatgtttctcccat

SEQ ID NO: 2237 - DNA, 61 bp, Homo Sapiens
ttgcttcattagaacaaaagatgctaatatygcctgggaaataccaagggatttaggggct

SEQ ID NO: 2238 - DNA, 61 bp, Homo Sapiens
aaattagttgagatacttacgatttctcatsatttctgtattttctacttcagtaaaattt

SEQ ID NO: 2239 - DNA, 61 bp, Homo Sapiens
atctggatggactctaagaaggctttgtccrgttgtgtacagtggaaatgatgctgtgcca

SEQ ID NO: 2240 - DNA, 61 bp, Homo Sapiens
aaaatagtatgaggaagagaaaaattataayggcatcacatatatgttgcatattctatgc

SEQ ID NO: 2241 - DNA, 61 bp, Homo Sapiens
ctcctaatgtcacacactcacaaataacttstcatcaggcgaagtcggcctcatcatgggc

SEQ ID NO: 2242 - DNA, 61 bp, Homo Sapiens
tggggcccctgccaagcacttaacatattcygtctccagtcctatacgccaagcttgtcca

SEQ ID NO: 2243 - DNA, 61 bp, Homo Sapiens
cttaactgatctggctattttttctcagctrtggacacagtcccttggcagattctcctgg

SEQ ID NO: 2244 - DNA, 61 bp, Homo Sapiens
aggctgaaatcctacaacattctaacacttyctccttataagcatccatatatctttactg

SEQ ID NO: 2245 - DNA, 61 bp, Homo Sapiens
cattcttcttacatatgtccaactctccggrcttcctccatggtttccaggtggcacataa

SEQ ID NO: 2246 - DNA, 61 bp, Homo Sapiens
ttcccctgaagctagcctctcttccatgctkactataatctgcttactccggtccccagtg

SEQ ID NO: 2247 - DNA, 61 bp, Homo Sapiens
tgatcagcacaacatcctgtgatgtcagcamtattgttactcttgttttacagatgaggaa

SEQ ID NO: 2248 - DNA, 61 bp, Homo Sapiens
aaacagacatttaggttgtctccagcctttytgagtcctgcttacctagaaggtaaaagat

SEQ ID NO: 2249 - DNA, 61 bp, Homo Sapiens
aatatgtctagaatatctctgcaatatgccyccaaatcaactaggagtggccactgcccct

SEQ ID NO: 2250 - DNA, 61 bp, Homo Sapiens
ttgtccaactggcctccccttctcaggtttytacatctcctctcctaccctagccctgcat

SEQ ID NO: 2251 - DNA, 61 bp, Homo Sapiens
tgattaggcaggttcagtagggtgatatttstaaagagcttggaacatgccaggtgcataa

SEQ ID NO: 2252 - DNA, 61 bp, Homo Sapiens
cagtcgagggcatgcaaataatcatagcccrcagtctacagccacaatggacacacacagg

SEQ ID NO: 2253 - DNA, 61 bp, Homo Sapiens
agccacggacacaacagaattcacttttaaygaggcttcagaaaacaacgtttaactatat

SEQ ID NO: 2254 - DNA, 61 bp, Homo Sapiens
gattttgcagacgcagctctgttaattccayttttttgtaggtgcttactattataatagt

SEQ ID NO: 2255 - DNA, 61 bp, Homo Sapiens
tttagggatgtggttttcaacaggaagctaytttgtccccctagggacatttggcaaagtc

SEQ ID NO: 2256 - DNA, 61 bp, Homo Sapiens
agcttttatcacctcgtcaagtcaggcaacrtatttccattagatccctaatttcgggtgg

SEQ ID NO: 2257 - DNA, 61 bp, Homo Sapiens
acaggcagaattaatctacagtgatagaagrgtagttaacctctgggtaggaaaatactga

SEQ ID NO: 2258 - DNA, 61 bp, Homo Sapiens
cactcactaaaatgtgcttaactcattgtaygtaaattgctcaacactctcactcaggaaa

SEQ ID NO: 2259 - DNA, 61 bp, Homo Sapiens
tactactattagtaataaatgtcttgtcacrgaccttgacacagactacaatacacaagtg

SEQ ID NO: 2260 - DNA, 61 bp, Homo Sapiens
tgttttctctaggaacctgaaagtagtggtwtataaggtcagtcatccactctaggtcaac

SEQ ID NO: 2261 - DNA, 61 bp, Homo Sapiens
ccagagagaaatagttgaaagaaactgtctraattattcaaaatatttcactgggagctgg

SEQ ID NO: 2262 - DNA, 61 bp, Homo Sapiens
gtgcagggggtaacctgttcagatcaagccrgtcagaaggctccacaagggacttttctca

SEQ ID NO: 2263 - DNA, 61 bp, Homo Sapiens
tgggggcaaatacatgcttcaaaatgttaaygcacttttcacattttctatcaaaaaaaaa

SEQ ID NO: 2264 - DNA, 61 bp, Homo Sapiens
caacagaatgctttgagattcagccttgttktctgtttcaaaagtccaaacatttttgatg

SEQ ID NO: 2265 - DNA, 61 bp, Homo Sapiens
ccgacttgtatttttttttttttttctgacrtctgacaatgaagcggtaggagtcaactac

SEQ ID NO: 2266 - DNA, 61 bp, Homo Sapiens
agcttacgtttgtgattagataggtacagtraaagtctatgatgacaaggtgagggggtcc

SEQ ID NO: 2267 - DNA, 61 bp, Homo Sapiens
gtgataaatctgcattttccagtggacattwgagttttggaaactgccatcataggcaaga

SEQ ID NO: 2268 - DNA, 61 bp, Homo Sapiens
gcagtggggacatcctggctccatccgaaargctgagtgtgttcccacggctgaggtggcc

SEQ ID NO: 2269 - DNA, 61 bp, Homo Sapiens
ggcgctgccaggagagccttccatctcgggkctctttgaggttccctccttctgggtgttc

SEQ ID NO: 2270 - DNA, 61 bp, Homo Sapiens
gtcagacactggctccaggtaccctgacacygcaagctgacatctgatgcacctggccaca

SEQ ID NO: 2271 - DNA, 61 bp, Homo Sapiens
  misc_feature (31)..(31): n is a, c, g, or t
gagagttggttattttaaaaatacattctcntaagctgcccagtcccgtctgttcatctgt

SEQ ID NO: 2272 - DNA, 61 bp, Homo Sapiens
tcgatccacaggaaaagtcccataaatggcygaatggcagaattagtagatgacattttaa

SEQ ID NO: 2273 - DNA, 61 bp, Homo Sapiens
cccccgtgggtgtgcaaaatcctgtatcatwaaaaaaaccagctgctcacacgcacacttc

SEQ ID NO: 2274 - DNA, 61 bp, Homo Sapiens
aaccaaggtgacgagaaaaaaggcacttctrtggcaagctctgctccgagtggccatgaag

SEQ ID NO: 2275 - DNA, 61 bp, Homo Sapiens
ttgcacggggtcagaaagacagacgggagtyagcaggtcacagccctgtgcccacaacagg

SEQ ID NO: 2276 - DNA, 61 bp, Homo Sapiens
aagaagctcagagacctgacaacagccacarcaaggacatgtgtgcacacaggccaggtgt

SEQ ID NO: 2277 - DNA, 61 bp, Homo Sapiens
aaatggcataaataaatgaagtctctgttcmtccatctctccatattgtttctgtcccacc

SEQ ID NO: 2278 - DNA, 61 bp, Homo Sapiens
ccctgtttggggaatggttcaagcccagatrgagtttcttgtatttgtcattaatagacaa

SEQ ID NO: 2279 - DNA, 61 bp, Homo Sapiens
ctcctaggggagaagaaagtcacgtggatargactatgctccctgaagatgctgagagaaa

SEQ ID NO: 2280 - DNA, 61 bp, Homo Sapiens
ccagcttggcttaagcccagaaacaatcacrggcagagaatggccgagttcaggtgtccag

SEQ ID NO: 2281 - DNA, 61 bp, Homo Sapiens
ttatttcccatggtgctttccaaacttaaayatgcatgtgaatcacctggggatcttaagc

SEQ ID NO: 2282 - DNA, 61 bp, Homo Sapiens
tatcatttatatgtaatgttgacacatgagmttttcctaatttgtttttaactgagatata

SEQ ID NO: 2283 - DNA, 52 bp, Homo Sapiens
ctgtttcctgagagccttcctygcagtgatgtccccaatgtcaattcctgag

SEQ ID NO: 2284 - DNA, 61 bp, Homo Sapiens
aaaccaccaaagcttaagtgttcatataacmaggaatcctcttgcttaaagttccagttgg

SEQ ID NO: 2285 - DNA, 61 bp, Homo Sapiens
tctctttggaagccctctagcagcagggacmtttctaaatccctaaaagcctgcagtggcc

SEQ ID NO: 2286 - DNA, 61 bp, Homo Sapiens
ttattaccaccaccaaacatttgcgtggtgytttacagctcacaacacagttccatataca

SEQ ID NO: 2287 - DNA, 61 bp, Homo Sapiens
ttaccacaaggatatgtcacttgttactgartggtcccaggcagcggcctcagcttttctg

SEQ ID NO: 2288 - DNA, 61 bp, Homo Sapiens
aactggtgctggatatggagtcagagttcarcacatgctggctatgttacatcattttgcc

SEQ ID NO: 2289 - DNA, 61 bp, Homo Sapiens
gtgaggagtgggtgcgcattcccttgcctgwcgccttgctgggggtagtcagatcccccag

SEQ ID NO: 2290 - DNA, 61 bp, Homo Sapiens
ttccttacaccctacatatccttttgggtcygtttagcaatgagaggcactgaagaatgtg

SEQ ID NO: 2291 - DNA, 61 bp, Homo Sapiens
ctactgcaatgtgaactccacaagggtattrctttgttcagcactgcatctgttcagcact

SEQ ID NO: 2292 - DNA, 61 bp, Homo Sapiens
ctgctttttatcctttaaactctctctgctyggccttgtctgtttcatcagtaaaggtggg

SEQ ID NO: 2293 - DNA, 61 bp, Homo Sapiens
agaagcctggttcttctgaagcttctgactrtcatcaaattggaagttaatgctgggggag

SEQ ID NO: 2294 - DNA, 61 bp, Homo Sapiens
ttgatatgtacatgaaatgtaggattccttytccagataaactgttagtgcatcattgata

SEQ ID NO: 2295 - DNA, 61 bp, Homo Sapiens
caggctggggtaagttcatgttgccacggaytctaggagggatctctgaagtgtcaagtac

SEQ ID NO: 2296 - DNA, 61 bp, Homo Sapiens
gctgggactacctaagtgtcttgaaaaataygtgcattctgataatggatgcaatacatca

SEQ ID NO: 2297 - DNA, 61 bp, Homo Sapiens
taagcgagggtggaggagagttggagagtcyttctcttctatgtataatcttctcaatgca

SEQ ID NO: 2298 - DNA, 61 bp, Homo Sapiens
catgggaaactgcatcccttgaggagactcrtctggacttctctctgccgggaggcactgg

SEQ ID NO: 2299 - DNA, 61 bp, Homo Sapiens
gtctggacttctctctgccgggaggcactgrcgttgtaagaaatgaaggaatggggtcagg

SEQ ID NO: 2300 - DNA, 61 bp, Homo Sapiens
gcaaaccccattagtgtataagagacattcrtttgtccatccctgaaggtgtaagcacaat

SEQ ID NO: 2301 - DNA, 61 bp, Homo Sapiens
gttcagagacatgcaaatcaaaactacaacraggcaccacctaacagcagtcagaatggct

SEQ ID NO: 2302 - DNA, 61 bp, Homo Sapiens
gaagcagccaacactagaaatataaacgaakgaatcatctatacagaggtagtaattaaag

SEQ ID NO: 2303 - DNA, 61 bp, Homo Sapiens
agaatcaagtcagaacaggagagggtttacractgaaccttgagcaagttcaaatttaaag

SEQ ID NO: 2304 - DNA, 61 bp, Homo Sapiens
acctaagtcccacaccatccataggaaggasagtaatgactccaaacaagagtagaaaagg

SEQ ID NO: 2305 - DNA, 61 bp, Homo Sapiens
gcataaatatgagaagttataataaatagtracacaaggtttaaaggagaaggaagaagga

SEQ ID NO: 2306 - DNA, 61 bp, Homo Sapiens
tcaggtgggtactagcaggcatgaaaatcawggcttctactttagacagctgctcttatag

SEQ ID NO: 2307 - DNA, 61 bp, Homo Sapiens
tttactgttggtatgtggcagtgaaaaatayatcagcgactaacatggtttggggtcatta

SEQ ID NO: 2308 - DNA, 61 bp, Homo Sapiens
ctcgttattcccatttattgtacctctatgytttttcctaatagttttacctaatattcct

SEQ ID NO: 2309 - DNA, 61 bp, Homo Sapiens
tggatctgctaatgggcttcagatactttcycttgctctaaaatagttgatcagacagcag

SEQ ID NO: 2310 - DNA, 61 bp, Homo Sapiens
tgggcacaattggttttaaagatgcttacarccccgttatcacctcataaaatggctcatt

SEQ ID NO: 2311 - DNA, 61 bp, Homo Sapiens
aacacaagtcccttgcctggcctgtcttatmctagccccttctcaaagccacctacctaat

SEQ ID NO: 2312 - DNA, 61 bp, Homo Sapiens
gtttgggattcaggccaacctggctcagccrtttcctagctgggatggcctctctgaaact

SEQ ID NO: 2313 - DNA, 61 bp, Homo Sapiens
gaatcactagcctacagaggaagtcaaaagmgccacctgtgaaaaacactcgactctcctg

SEQ ID NO: 2314 - DNA, 61 bp, Homo Sapiens
atttgaaggtcactgtggctttgtcttcatygaggacatcagaaagtttggcagtttctct

SEQ ID NO: 2315 - DNA, 61 bp, Homo Sapiens
gccaacgtggaggaaagggagcagccagccrtttgggagaagatctcaaggatccagactc

SEQ ID NO: 2316 - DNA, 61 bp, Homo Sapiens
ggcccactgtgacttccatggtctgaggacktttctagtctctgaggcttcgggaccatag

SEQ ID NO: 2317 - DNA, 61 bp, Homo Sapiens
tgggctgtgggaggagggaagcagatccatstgaaggccacactccatgcaccctcctcca

SEQ ID NO: 2318 - DNA, 61 bp, Homo Sapiens
gcgtgcatgagcttcatagcacatcacttcrggtgccacacactatctggctgagtcacaa

SEQ ID NO: 2319 - DNA, 61 bp, Homo Sapiens
atgttagagctcccagccccttatgcagacygtggtcacctcacttctagggccattcttg

SEQ ID NO: 2320 - DNA, 61 bp, Homo Sapiens
ctggtacacagttggtgctcaacaggtgttyactgaatagatacaaaaatgaacaaattca

SEQ ID NO: 2321 - DNA, 61 bp, Homo Sapiens
ctgagcctggttcttcatctgtaaaatggamgtagtagtacctccgagggttgccgtggaa

SEQ ID NO: 2322 - DNA, 61 bp, Homo Sapiens
tcctggggtcgtcgccctcaagatgattatygtaggagtagtcctccacctcgtcgcagat

SEQ ID NO: 2323 - DNA, 61 bp, Homo Sapiens
taaaaagaaatctgggaattcactatcactmgacttaaatagaaggcaactgtaaaaacat

SEQ ID NO: 2324 - DNA, 61 bp, Homo Sapiens
ggcagctcacagacaaacagcttatacatgrctaataaacaagaaaagacgggctgggcgc

SEQ ID NO: 2325 - DNA, 61 bp, Homo Sapiens
attgagaatcagtgacttaaactttcctacrgtgtgacccccaatcccatcattctcaatc

SEQ ID NO: 2326 - DNA, 61 bp, Homo Sapiens
acaggaccatgcactgaggagtatgatggamgatgctctagaaattctcgaaaaccacctt

SEQ ID NO: 2327 - DNA, 61 bp, Homo Sapiens
gagtatgatggacgatgctctagaaattctygaaaaccaccttttcctctccaagtaaacc

SEQ ID NO: 2328 - DNA, 61 bp, Homo Sapiens
agaaaggcgttgttttccttttgatgtactyttctctcattgtaggtgcacttttacctcg

SEQ ID NO: 2329 - DNA, 61 bp, Homo Sapiens
aaagcactgttttacatcatgggctaaagargaacacagctgacttgcgtgaaaatactca

SEQ ID NO: 2330 - DNA, 61 bp, Homo Sapiens
aaagcattggaaaacagtagtaaatagataytgaactcgagctgtggatggatcttgcaga

SEQ ID NO: 2331 - DNA, 61 bp, Homo Sapiens
tcattctttgttattaatagcaaggaacgtrtgcagagaaaggtcctatggggcaagagag

SEQ ID NO: 2332 - DNA, 61 bp, Homo Sapiens
acagtagttcttaaacttcaatgtactcagsattacccagggagcttgttaagtgtgcaga

SEQ ID NO: 2333 - DNA, 61 bp, Homo Sapiens
tccaggcactggattcattaatcctcccaayctttctgtgaaatcagcactattattcacc

SEQ ID NO: 2334 - DNA, 61 bp, Homo Sapiens
attttacagattagggaaatgaagacactaraacagagaagagaagtgatttgtccaaaac

SEQ ID NO: 2335 - DNA, 61 bp, Homo Sapiens
tgactttattctttccatcataagctggatrattaggagctagaggcagccagtaattaag

SEQ ID NO: 2336 - DNA, 61 bp, Homo Sapiens
tgaaaatatccattagaggtttctgttttcycagagaactccccttagcctaccgtggtat

SEQ ID NO: 2337 - DNA, 61 bp, Homo Sapiens
actcttctgcaagaggttgatttagctgtaytttccaaacaaatgcaatgtcttccccaag

SEQ ID NO: 2338 - DNA, 61 bp, Homo Sapiens
cctgcagtcatctctccatggtgtagccagygtataggcattaacagatttacatcaggtt

SEQ ID NO: 2339 - DNA, 61 bp, Homo Sapiens
aaatattatgcagaccagtaggaataagttkggctggtttccacaccgggctgccatttgt

SEQ ID NO: 2340 - DNA, 61 bp, Homo Sapiens
gaacttccagagtctataccactgccagagwctattttgggatgggggctagagctgatat

SEQ ID NO: 2341 - DNA, 61 bp, Homo Sapiens
gcatttcatccctcctgccaagcatgcgttkttcacttgctggttttacctgtgagcatta

SEQ ID NO: 2342 - DNA, 61 bp, Homo Sapiens
caaagtcaaacccccttcccctggtaccacygaagtgaatcactgcagctcaggcaactct

SEQ ID NO: 2343 - DNA, 61 bp, Homo Sapiens
agcctaatattttcctgctactgagcttgaygtagtgtacacttgctcaaacctcaatgca

SEQ ID NO: 2344 - DNA, 61 bp, Homo Sapiens
tttataatagcatattccttctacgtactcrgtcactgctagcagatccccccaatgcatc

SEQ ID NO: 2345 - DNA, 61 bp, Homo Sapiens
ccggcaacgcgctgcactgtaagatcccttytctgcgaggcccggagggggatgcgaacgt

SEQ ID NO: 2346 - DNA, 61 bp, Homo Sapiens
ggtggtatgccttaaatcacagagtgtgggragaatcaggtcagctagagagaaccagccc

SEQ ID NO: 2347 - DNA, 61 bp, Homo Sapiens
cccatgggcaagactgtcacttatggctagraatggagacaagctgacctcaaccatgatg

SEQ ID NO: 2348 - DNA, 61 bp, Homo Sapiens
tgatcaatttttattttaaatgaagaatacyaccagaaataatgaatcacaatttactatc

SEQ ID NO: 2349 - DNA, 61 bp, Homo Sapiens
ggagcattatttgggagccaaggtggatgcrcagctgaaggtgctttatgatgaactcctt

SEQ ID NO: 2350 - DNA, 61 bp, Homo Sapiens
tgtggcctccttactgttaaccctgcagtaktcttgctacatagcaactgggtgattctgt

SEQ ID NO: 2351 - DNA, 61 bp, Homo Sapiens
ttctccttgcctctccttcctcttaccttgmccctcttaatttagctccagtctatagaaa

SEQ ID NO: 2352 - DNA, 61 bp, Homo Sapiens
gtgtgtaataatctattttcccgggctgctstaaggaagaaaaaggattgtgcatggtgag

SEQ ID NO: 2353 - DNA, 61 bp, Homo Sapiens
tatccagctcttctgttaagtgtgtcaaaaytgaagtccgagagggtagattgtcacattt

SEQ ID NO: 2354 - DNA, 61 bp, Homo Sapiens
tgagtaaagccagcctcaggtgagaaaccarctacagataacctacaaaacagattgctta

SEQ ID NO: 2355 - DNA, 61 bp, Homo Sapiens
ttccttatatctttcttactcatatattggrttctatttcaacacatgcttaatgaaaaaa

SEQ ID NO: 2356 - DNA, 61 bp, Homo Sapiens
ttctattgatctttgttcttcacattcaatmaaaggccctgcttgctgttttcattctcta

SEQ ID NO: 2357 - DNA, 61 bp, Homo Sapiens
gttcctactcaactgtaggatttccaagtgyctcaagtgcttgaagctgttcactttgatg

SEQ ID NO: 2358 - DNA, 61 bp, Homo Sapiens
ggcagccatgctcagtggtcaagagaaaagrgtccaatgtgagacttcttgagatcatatc

SEQ ID NO: 2359 - DNA, 61 bp, Homo Sapiens
tacttccaacagaacaggtgctgatattcaygactgagagacccatagacagttcacatca

SEQ ID NO: 2360 - DNA, 61 bp, Homo Sapiens
gcatgtggttatcttttactgaatgcataamataaaatcacgcttcagcattaaacttggc

SEQ ID NO: 2361 - DNA, 61 bp, Homo Sapiens
attttcatgtgttattgatattcttatgtcrtataccacataaaaaaggggtctttataag

SEQ ID NO: 2362 - DNA, 61 bp, Homo Sapiens
ttctgggaatctcctggatctttttcttgcrgttctgtgttctttctgggctattcttcct

SEQ ID NO: 2363 - DNA, 61 bp, Homo Sapiens
taacagatgtgttaacttgcttctttgtagyaacatttttacaacctgtatgcatcccata

SEQ ID NO: 2364 - DNA, 61 bp, Homo Sapiens
gagttactgtaaatctgaacgtgaatgctartcgtgaagttcgtttgttttttgttttctt

SEQ ID NO: 2365 - DNA, 61 bp, Homo Sapiens
ctctttgccttgctgatgcccactcattttwtagatttccacttaacaatcaattccttat

SEQ ID NO: 2366 - DNA, 61 bp, Homo Sapiens
gtttaaccaaagttttttttgtcagctagamttaaagttcatctaacaatgcaaggcacaa

SEQ ID NO: 2367 - DNA, 61 bp, Homo Sapiens
ttggctgagatggacttaaagagacaagaaktgatttgcagatatcactcccatctctttt

SEQ ID NO: 2368 - DNA, 61 bp, Homo Sapiens
ttcaaataagtgttttccatgaaagttacaytggagtattggctggtcataaagaagaaat

SEQ ID NO: 2369 - DNA, 61 bp, Homo Sapiens
tataccctaggtcttgtatgggactgttacmgataatggataacattttaaggcagtgttt

SEQ ID NO: 2370 - DNA, 61 bp, Homo Sapiens
tgattacagctgaaagaaacaccttggctcyaataagttactttgatttaaaagagtttat

SEQ ID NO: 2371 - DNA, 61 bp, Homo Sapiens
gagatcattgttttatagtcttagcatgtgytacgtttttgaaaatatgccattgtaaagt

SEQ ID NO: 2372 - DNA, 61 bp, Homo Sapiens
cacaagcattttttgaggtagttactgttaygctcattttacagttaactgaggcttattg

SEQ ID NO: 2373 - DNA, 61 bp, Homo Sapiens
aattggcattatcagaaagactagttagagrcaatctaggagagaaacgctagaatctgga

SEQ ID NO: 2374 - DNA, 61 bp, Homo Sapiens
accacagacagtgagagagtttgtagacagwcattactaaaagtgaaatatttttatatat

SEQ ID NO: 2375 - DNA, 61 bp, Homo Sapiens
ataattgatttggcaaatacaacccattatrttggccattaaccaactggatctgccttta

SEQ ID NO: 2376 - DNA, 61 bp, Homo Sapiens
gcggcagtggcagagtttgggtttgtagagrcagcaatccttaacccaaaggaacatattt

SEQ ID NO: 2377 - DNA, 61 bp, Homo Sapiens
ggacccagttatgtagaagtggctgattccytttcttccttttggccccagtgcgtaaggc

SEQ ID NO: 2378 - DNA, 61 bp, Homo Sapiens
ttcactctttataacaatagctatcaattakcgcacactctaggggccaggcaccatgcta

SEQ ID NO: 2379 - DNA, 61 bp, Homo Sapiens
ctgcatgtgattgtggatgaggtctacatgytgtccgtgtttgagaagtctgttgggtacc

SEQ ID NO: 2380 - DNA, 61 bp, Homo Sapiens
agaaaaagaaagtggggaccagatcatgtgkgtagtctgtgaatctcaccttcaggggttc

SEQ ID NO: 2381 - DNA, 61 bp, Homo Sapiens
cttaagacagttgggctcaacagcacactgrgattgtgggaccgtcttctgattgggacaa

SEQ ID NO: 2382 - DNA, 61 bp, Homo Sapiens
aaacttctcccttacacagaaacattccaarcctgtcataagctgtctctccctgaaccct

SEQ ID NO: 2383 - DNA, 61 bp, Homo Sapiens
gtaggcttcctagtcattagtcctatcttayacagctggccaaacaggtgctgaagggcaa

SEQ ID NO: 2384 - DNA, 61 bp, Homo Sapiens
gggatgggcaccagcctcctggctcatcacygattattagagggccacaggtagcccgggc

SEQ ID NO: 2385 - DNA, 61 bp, Homo Sapiens
atcctctctcatagttgcacacatatgactwgaaagggactccattttccagtggaaagtt

SEQ ID NO: 2386 - DNA, 61 bp, Homo Sapiens
ccctatattgttttggtcataggctggcctrtttgtattaagactctcccactagcatgtg

SEQ ID NO: 2387 - DNA, 61 bp, Homo Sapiens
ggtccaaagcccactgcccctatggctctcratgtttgtcctgccttcaaatctttcccca

SEQ ID NO: 2388 - DNA, 61 bp, Homo Sapiens
agaactgaatcctgccaacaaccacaagagsaagcttggaggtagaggttgccccagtcaa

SEQ ID NO: 2389 - DNA, 61 bp, Homo Sapiens
ttaatagttgctcaatacagacagcaaatgyttgttgaaaactcgccagctactgtggttt

SEQ ID NO: 2390 - DNA, 61 bp, Homo Sapiens
acgttttacagtgccgctcattatgtaaagmctcctgaggagccagtaaggtagacaaggc

SEQ ID NO: 2391 - DNA, 61 bp, Homo Sapiens
ttatggataatttgaagcatacagaagagargataattgaatgaacccctattacccagct

SEQ ID NO: 2392 - DNA, 61 bp, Homo Sapiens
gttggaatgtagggtgggaatatgagaaagyggcaatgggttttggactgaaaggaagaag

SEQ ID NO: 2393 - DNA, 61 bp, Homo Sapiens
gtaatgttaacaggtaatatttagcgctgtrtgaaactttctaagtactttgaatatattg

SEQ ID NO: 2394 - DNA, 61 bp, Homo Sapiens
ttataagtctgtgccattttagacctggtakcttcctgcttctgggcaatctttttgtggc

SEQ ID NO: 2395 - DNA, 61 bp, Homo Sapiens
acttccccagaggatttggaaatatgcttcytactgctctgtgcccctgggcagagatgct

SEQ ID NO: 2396 - DNA, 61 bp, Homo Sapiens
ctttaaggaggaatctatccagtggcccaamttgctagagcttctgcaccttttttcgttt

SEQ ID NO: 2397 - DNA, 61 bp, Homo Sapiens
attcaacaaataaatgttgaatcagtctccrtgccacatgctgacaaacaagccatggtct

SEQ ID NO: 2398 - DNA, 61 bp, Homo Sapiens
ttatcagctgcaattttagctggtgctaaakatagttggaaaacctattttataatgcttg

SEQ ID NO: 2399 - DNA, 61 bp, Homo Sapiens
cccaaaatgtacaacatggctggaaaggctstccataatccagctctagctaccactttga

SEQ ID NO: 2400 - DNA, 61 bp, Homo Sapiens
ttccttccttcctttctctctctttcaacayttatcaccatctgcctgcatacacatttgt

SEQ ID NO: 2401 - DNA, 61 bp, Homo Sapiens
gtataaactgccattgatttctgataacacrtagcaattacttaatgctgcagacttgatt

SEQ ID NO: 2402 - DNA, 61 bp, Homo Sapiens
tgagcacaccgggctgtttcctgatttctgscaacaacactcttttcatctttttacacct

SEQ ID NO: 2403 - DNA, 61 bp, Homo Sapiens
actctccacttggcttagactgaggtaatayttaacaatcatggaccttaaaagtattggt

SEQ ID NO: 2404 - DNA, 61 bp, Homo Sapiens
ttaccacaggtgaaaatagatatgattctasagaggaactttttgtttttccccagcaaga

SEQ ID NO: 2405 - DNA, 61 bp, Homo Sapiens
ttagatttgcttagccttgacagaaatactrggaaagagacaattatggcttgccaaatac

SEQ ID NO: 2406 - DNA, 61 bp, Homo Sapiens
ctgatatacaaaattgtaagatgataattaygtttttttaagccattaaatttgtggtgat

SEQ ID NO: 2407 - DNA, 61 bp, Homo Sapiens
tcttaaatccacattcaaaactcagaggttrtttgcttgaactctgaaaatcgatacgttt

SEQ ID NO: 2408 - DNA, 61 bp, Homo Sapiens
atgtttcacaatgcaggaaatacacaatacmagtagcatattaaatcaaacatacccaaat

SEQ ID NO: 2409 - DNA, 61 bp, Homo Sapiens
gggaaatgaaggcagcttctgcaagaccccrggaaggtacattctctctgacaccaccagg

SEQ ID NO: 2410 - DNA, 61 bp, Homo Sapiens
cttccaggattctgcacatctcattagcttyatattcccgtaagtacttgggtttctgctt

SEQ ID NO: 2411 - DNA, 61 bp, Homo Sapiens
agatgttcacaatatactaacagctattttytcccctaatttcctaaaagtgtgttttccc

SEQ ID NO: 2412 - DNA, 61 bp, Homo Sapiens
agctgaaaatctactccacgatgaaagatcrgaatgtggcacaagttcttttcaccgaata

SEQ ID NO: 2413 - DNA, 61 bp, Homo Sapiens
aagttgactctaaaataacaaatacttgacmtctaattatccaaagaatacatttaggaaa

SEQ ID NO: 2414 - DNA, 61 bp, Homo Sapiens
aattaatcaaaccacaggccactggcttgtwgtaatactaattcaaacaaggtttctaagc

SEQ ID NO: 2415 - DNA, 61 bp, Homo Sapiens
tttaaaatcacactggctggtaggtgaatayggtgtttcattacaatcattacatttacca

SEQ ID NO: 2416 - DNA, 61 bp, Homo Sapiens
gcaaaggccaaaatgtcactgataagctgtktaaagggacaatcacatgggatagggtgta

SEQ ID NO: 2417 - DNA, 61 bp, Homo Sapiens
taatttcgatctagttagtatgttaaagacrtgttcatttaaagagaaagccattttgtgt

SEQ ID NO: 2418 - DNA, 61 bp, Homo Sapiens
tgtactaggggccaaaaaactttatgaaacrcagatagaaaacagtttaggctttctgggc

SEQ ID NO: 2419 - DNA, 61 bp, Homo Sapiens
tagccaaaaaccacataattaactgcagatytttcaaaggtaacagttattgattttaaat

SEQ ID NO: 2420 - DNA, 61 bp, Homo Sapiens
aacagctaagagctattattaaacctttttyacagatgagaaaaaactaaactttcttaag

SEQ ID NO: 2421 - DNA, 61 bp, Homo Sapiens
gaacactgtaatttatataagtgagtggagytttatgattataatatgcaccttggaagcc

SEQ ID NO: 2422 - DNA, 61 bp, Homo Sapiens
agccatcaagctgtacctcctgcactagacyaactgtaagagtgagacagatgccaggaag

SEQ ID NO: 2423 - DNA, 61 bp, Homo Sapiens
tctgcctcctgctatcgccaaggtataatayagagctccttctaccataaatacaaggtaa

SEQ ID NO: 2424 - DNA, 61 bp, Homo Sapiens
atttttttccccataggcttatatgaaaatyagtttatgtttcttgagcacatttaccacc

SEQ ID NO: 2425 - DNA, 61 bp, Homo Sapiens
agaaatgcccttccatggcctcatgccagaygttgaatggttgaatgtttataactctaaa

SEQ ID NO: 2426 - DNA, 61 bp, Homo Sapiens
acgacagggttgagacaccaagacaaaggcrgaggagagaaagctggtgatgccactaccc

SEQ ID NO: 2427 - DNA, 61 bp, Homo Sapiens
acatttactgacataaaggatctctagcacrgtattttcaaataaggaatccacaatattc

SEQ ID NO: 2428 - DNA, 61 bp, Homo Sapiens
gtgtaatgttatgatttctgccataaggggygcatccatacagccaggattcccttgggat

SEQ ID NO: 2429 - DNA, 61 bp, Homo Sapiens
acttaagagtatctgagtgtttccataatgytcatgacccatgtgtaaccttccagctgta

SEQ ID NO: 2430 - DNA, 61 bp, Homo Sapiens
tggcctcccggctgccgaacggaggaacgcsgcaagctccgctcttgaaattacttgtttt

SEQ ID NO: 2431 - DNA, 61 bp, Homo Sapiens
gaagcatatccagagtctgtctggggcattyggcatctcgcatgtcctttgtgttcatgcc

SEQ ID NO: 2432 - DNA, 61 bp, Homo Sapiens
tcctcttgtcctggcatagttcctaagtccyctttcactctcgaaatatcctggcgtggat

SEQ ID NO: 2433 - DNA, 61 bp, Homo Sapiens
gtgctggggatatggctgtgagtgagacagytgaccgcatggcatttgcactcttatctgt

SEQ ID NO: 2434 - DNA, 61 bp, Homo Sapiens
taaccactcacatgtgtccagtaccttccaygtatttgttacgcacttttgcctctgtgtg

SEQ ID NO: 2435 - DNA, 61 bp, Homo Sapiens
ctcctgaggaaacccagatagctaggacagrgacataaaggagctgactaatcagggagtg

SEQ ID NO: 2436 - DNA, 61 bp, Homo Sapiens
ataaaagagtggtaccatgcatcagaagtargtcctagaatgtgacaggtgaggtatgggg

SEQ ID NO: 2437 - DNA, 61 bp, Homo Sapiens
tgttagaaaagggctctcatttggagaaatsagacgcattcaaataatatgaactggccag

SEQ ID NO: 2438 - DNA, 61 bp, Homo Sapiens
agggctccagaggaggaacagaagcttggcrctaaaaatgaggagctgaaaacccaaagaa

SEQ ID NO: 2439 - DNA, 61 bp, Homo Sapiens
ttttctgtatcaagcccagatagttctcttrgctcctcctcatctatatccacaagctgtg

SEQ ID NO: 2440 - DNA, 61 bp, Homo Sapiens
gtcagcaatgagtggtccagggtcagtcaargtattttaatgtcatgattcactcctgcct

SEQ ID NO: 2441 - DNA, 61 bp, Homo Sapiens
tatctttctgcaggtctagggatgataagarctctactattgttaattccaggttacaacg

SEQ ID NO: 2442 - DNA, 61 bp, Homo Sapiens
gcagtttaaaggatcaaatgagataatgagygttaaggtgttttgaaaaacatacaactgc

SEQ ID NO: 2443 - DNA, 61 bp, Homo Sapiens
tgcaaaagcattaagcagggagcatagctgsaatagttgagaaatagccaggaagccagtg

SEQ ID NO: 2444 - DNA, 61 bp, Homo Sapiens
tcctcccttcattcatttctccctcatttgyatgtaatcttcagcaagttagatcacttcc

SEQ ID NO: 2445 - DNA, 61 bp, Homo Sapiens
ttgacagaaagagtcagagctacaggaacaycaagaagtgtagatgtgctccgactgatac

SEQ ID NO: 2446 - DNA, 61 bp, Homo Sapiens
atacagaaagcagtttaaagcaaaggtatakgaatattgctagcaatacctgctaccctca

SEQ ID NO: 2447 - DNA, 61 bp, Homo Sapiens
tgaacaggggcttggtaaaacaaggttgagrtctactaggttgcattcccaggaggttagg

SEQ ID NO: 2448 - DNA, 61 bp, Homo Sapiens
gatttgctctgaccatgtcaattgttaagamttagctgtcagctgacctccgtggctgact

SEQ ID NO: 2449 - DNA, 61 bp, Homo Sapiens
ctttatgcagctggggatttgagataatgtyccagtaaccctcacaagattggtttggttc

SEQ ID NO: 2450 - DNA, 61 bp, Homo Sapiens
cttagtcacttctcatctttggttcctccartctctggtgtgttgtatatttttattctta

SEQ ID NO: 2451 - DNA, 61 bp, Homo Sapiens
gaacactggtgaaaataaacctttattgacrtactgactttgacatctttctggtttatga

SEQ ID NO: 2452 - DNA, 61 bp, Homo Sapiens
gtgattagcactttatcaatattcgtccccstaaaacccacaagaggttttttattttaca

SEQ ID NO: 2453 - DNA, 61 bp, Homo Sapiens
aagtttctgtggggataactgcctgccgacrtatatggaaagcgctcgttggggagaaaat

SEQ ID NO: 2454 - DNA, 61 bp, Homo Sapiens
tcacttcatagccatcattcaaggtgggcartattaaaagatcagaaaaatactgcgttga

SEQ ID NO: 2455 - DNA, 61 bp, Homo Sapiens
tatttcaaagacagggtctttgtccttttawgactactcacttagcctaatatcctcaacg

SEQ ID NO: 2456 - DNA, 61 bp, Homo Sapiens
gagataattggggtttctcatcagttgactkgagttgatcagagcccagattatactgggt

SEQ ID NO: 2457 - DNA, 61 bp, Homo Sapiens
acttcatgtaaaatctcttcctagacatacmtattcagtactataatttttggtttctaac

SEQ ID NO: 2458 - DNA, 61 bp, Homo Sapiens
agcctccgttttctgagttgaagagttaagyccctactcaccatcatgaatatgtgtctaa

SEQ ID NO: 2459 - DNA, 61 bp, Homo Sapiens
agatgtataataccaaaatgcagctgtcacrttatttttgttacccaaaagcactgtctat

SEQ ID NO: 2460 - DNA, 61 bp, Homo Sapiens
agtatacacgcaggtggataaaataaagaargtcagtttaagtaagcacgcagtagccatg

SEQ ID NO: 2461 - DNA, 61 bp, Homo Sapiens
tggggctgaagaatccacttctaaggtgataytgatgtggttattgaaagacctcagttcc

SEQ ID NO: 2462 - DNA, 61 bp, Homo Sapiens
agaaaaatgcaggcataccttactttattgygctctactttactgtaattcacagatagtg

SEQ ID NO: 2463 - DNA, 61 bp, Homo Sapiens
ccttgggtagcctttactttaatccacagtmtgttagctaatccttacaaacggctgaaga

SEQ ID NO: 2464 - DNA, 61 bp, Homo Sapiens
gggtttgtctttattttaacgaactcaaatmtctaccagtgctgaggtgactacccaggga

SEQ ID NO: 2465 - DNA, 61 bp, Homo Sapiens
ggtggtgagtcgagcgtggcttcttaaaagkctcaggactgggccataaacacattattgg

SEQ ID NO: 2466 - DNA, 61 bp, Homo Sapiens
aaccagatagcctaacgtgcatgtgaaaatygagaaagctgaaaacaaatccaggtaccct

SEQ ID NO: 2467 - DNA, 61 bp, Homo Sapiens
gaaaataactgaaaagattaaaagtgagagytgaaaagagaaatgataatgcttccaaact

SEQ ID NO: 2468 - DNA, 61 bp, Homo Sapiens
gatgtttgccaaatggtgacatttatttccrtcattctgtctacattttattaattggaat

SEQ ID NO: 2469 - DNA, 61 bp, Homo Sapiens
actgcctttcattgtattcaaatcaaaatcrgggctgtcactaaattttgttaatataaaa

SEQ ID NO: 2470 - DNA, 61 bp, Homo Sapiens
ggacgacatagtgagggtggtgacccatgaygactgcatccctgaggtaagcctggcaaaa

SEQ ID NO: 2471 - DNA, 61 bp, Homo Sapiens
tgcttgaggccaagagtttgaggttagcgtrggccacatagaaagactctgtctctataaa

SEQ ID NO: 2472 - DNA, 61 bp, Homo Sapiens
gcctgttttgtaatcatgcctctgctatttstcacatcatcatgcctgcccatattctgga

SEQ ID NO: 2473 - DNA, 61 bp, Homo Sapiens
tgaatccctgctgggttgcctgggagaaaayaggagaagtcagaaatgcctggagggagcc

SEQ ID NO: 2474 - DNA, 61 bp, Homo Sapiens
agttttgggggcaagagtggacataaaaagyggaggatatggcctgaggacaccactcact

SEQ ID NO: 2475 - DNA, 61 bp, Homo Sapiens
gagagcccaccgactcctgggacatcaagargtggacaggtaacaaaatgggacaagtgaa

SEQ ID NO: 2476 - DNA, 61 bp, Homo Sapiens
aatttttcacagcttcagcttctagaaagtyagtgtcattttgtttcaacttgaactccct

SEQ ID NO: 2477 - DNA, 61 bp, Homo Sapiens
ccataatgtcatattaatggaattgttcaaygtgtggcctttggggtctggtttgtttcct

SEQ ID NO: 2478 - DNA, 61 bp, Homo Sapiens
aaatatgctggaaacacaacaaaattcaatracatatttgctgaaggaggacatatactta

SEQ ID NO: 2479 - DNA, 61 bp, Homo Sapiens
atacctcagtataattcccaaatttagatcytttctgctgtactgtgctgtttggccccac

SEQ ID NO: 2480 - DNA, 61 bp, Homo Sapiens
agtttctctgttctctgcacgtgtttattaytgctatcaccagcttggaggaattcttgtt

SEQ ID NO: 2481 - DNA, 61 bp, Homo Sapiens
gagacagggacagccgtgcaaatggggcttyccgatgataaagtaattttaacactaacta

SEQ ID NO: 2482 - DNA, 61 bp, Homo Sapiens
cctatttcttcagcatttagacattaatccmagattcagaaataaagtcaagtaactattt

SEQ ID NO: 2483 - DNA, 61 bp, Homo Sapiens
aaaatgacttgtaattaataggtgacttgasagtaattcaaattcctggatatgtaaaaat

SEQ ID NO: 2484 - DNA, 61 bp, Homo Sapiens
tataaatgaggagatactacttttgaaacarccaattctccaaacatcatttctatttatc

SEQ ID NO: 2485 - DNA, 61 bp, Homo Sapiens
gcacatgactgatggtcataatactataaaytctaggatgcttacagaggcaaagatgaca

SEQ ID NO: 2486 - DNA, 61 bp, Homo Sapiens
agccttagtgaacttgttaaagatccttctragcgccatgctttcacctctaggtcttcgc

SEQ ID NO: 2487 - DNA, 61 bp, Homo Sapiens
aggggaaacagagtgagcagtgttcagggaygcagcccaccttcctgggtagttttccact

SEQ ID NO: 2488 - DNA, 61 bp, Homo Sapiens
gataaaagaatgcctacgtattaactacctrttttgtgccataccttgtccaaatcctgta

SEQ ID NO: 2489 - DNA, 61 bp, Homo Sapiens
cctgaagatagagcgttgaacaaacccaatrgtcttggccctcaaaaagctttatgtgaca

SEQ ID NO: 2490 - DNA, 61 bp, Homo Sapiens
caatattgggtgagaaaatagatcccgtttycaaccatgctagatatggtttctaatcacc

SEQ ID NO: 2491 - DNA, 61 bp, Homo Sapiens
gagaaatattaatttgggatagaacctatgkcttttagtaactgaatggaaatgtaggtga

SEQ ID NO: 2492 - DNA, 61 bp, Homo Sapiens
tgatttgtagaccagcaacatggaaattacytgggagcttgctagaaacccagtgtttcag

SEQ ID NO: 2493 - DNA, 61 bp, Homo Sapiens
gctatatcatcaagattgatgaacagatagyttatatacaagaaaaatcagacatttaatt

SEQ ID NO: 2494 - DNA, 61 bp, Homo Sapiens
acccttgcccagcacctcaaattacataaaycgaataatgttggccaacaaactgctgatt

SEQ ID NO: 2495 - DNA, 61 bp, Homo Sapiens
ctgctgaaaagctattgccctctgctatgtrcaacattccatggcttcaattcaaggataa

SEQ ID NO: 2496 - DNA, 61 bp, Homo Sapiens
aaaaccaagcattgaaatgatggtcatttargcattcttctcagaaaactacctacctagg

SEQ ID NO: 2497 - DNA, 61 bp, Homo Sapiens
caatattagtagtaagattatgttttccccktgaggttccactaggttggcatgttccaat

SEQ ID NO: 2498 - DNA, 61 bp, Homo Sapiens
ctttatcatcctcagatcctgttggtcctgsatacatctccctaccatgctccccttcaaa

SEQ ID NO: 2499 - DNA, 61 bp, Homo Sapiens
gatgtggaggcacaagttcagggcagtgtayggtacactttaattcaatttctgacaaaat

SEQ ID NO: 2500 - DNA, 61 bp, Homo Sapiens
attgcagcaggcagctgtgaaagggactgtyttctctagctacatgtgaacttgaaaattt

SEQ ID NO: 2501 - DNA, 61 bp, Homo Sapiens
gggatgtcaagaaagggaaagcaatgacaayggttgggcctggttgacacaataattatct

SEQ ID NO: 2502 - DNA, 61 bp, Homo Sapiens
agaaagtatagaggcctagatttgagtcttkttttggctggacttgtcattttacccctct

SEQ ID NO: 2503 - DNA, 61 bp, Homo Sapiens
caacccgtacacccacacctattcatactcrtgctctggctcggcaatcacctgtagcagt

SEQ ID NO: 2504 - DNA, 61 bp, Homo Sapiens
caaccctatgaatccacttgcagctcctaargtgtgtgttgtgccccggagtcgtctagct

SEQ ID NO: 2505 - DNA, 61 bp, Homo Sapiens
tatgggttaattcaattaagaatttttcacwctggacaacggtaaagacttgatatataaa

SEQ ID NO: 2506 - DNA, 61 bp, Homo Sapiens
tgtggtgtttcttaagtagacctgtgttcaygttttataacgcgaaagcagatgcaaagct

SEQ ID NO: 2507 - DNA, 61 bp, Homo Sapiens
aatcagcacacaggcagatgtatcactagayggcattatctgtactgcgtggctggcaagc

SEQ ID NO: 2508 - DNA, 61 bp, Homo Sapiens
tcaaaattcaatgagcggcaaaatctgaccyaaactgagtcatggctatttataatcttaa

SEQ ID NO: 2509 - DNA, 61 bp, Homo Sapiens
cccatcttaacaactgtactattaccatgtygaccctcttaaaaagagtaagagccgtcct

SEQ ID NO: 2510 - DNA, 61 bp, Homo Sapiens
agggagctcttctatggatcagttatttctyacagttgctactccttaaattcagaataga

SEQ ID NO: 2511 - DNA, 61 bp, Homo Sapiens
gagctttcacctgggagctgatagatggtcstcacttcttaatgtggtgctgggcctcagg

SEQ ID NO: 2512 - DNA, 61 bp, Homo Sapiens
tggacgtttgtgtggatggtgcagtgttctyggaatctgtagaccagatcggtggaggtat

SEQ ID NO: 2513 - DNA, 61 bp, Homo Sapiens
ttgaaagaacaccaaaagatagtcgtttaarggatcaagtttggcttcatggtgcacttaa

SEQ ID NO: 2514 - DNA, 61 bp, Homo Sapiens
ttagtctttgtttcggagttgcctcttataytggtgacactccagctttgctgaagtcgtg

SEQ ID NO: 2515 - DNA, 61 bp, Homo Sapiens
gccaaggctgagtgatttaggagtcatgatrctggagagactcaagccccactcccttcct

SEQ ID NO: 2516 - DNA, 61 bp, Homo Sapiens
cctaatggaacccaggtgagtgatgcccacrgaaaaccatgtggtaaggaaggacataagg

SEQ ID NO: 2517 - DNA, 61 bp, Homo Sapiens
agaaggatctttaataaatcctataatctastagccttttagtagtcacatgtaaggaaca

SEQ ID NO: 2518 - DNA, 61 bp, Homo Sapiens
ccttaagtatttatttatatgtgttgggaawgtttcaagacctgtcttctagctattcgga

SEQ ID NO: 2519 - DNA, 61 bp, Homo Sapiens
gtcttgagtatctgtaagtgaatactggtartcagcttggggtggagagaaagtgatttga

SEQ ID NO: 2520 - DNA, 61 bp, Homo Sapiens
atgggagattgcattattattcccaattacygacttttccatctcagtaagaagattataa

SEQ ID NO: 2521 - DNA, 61 bp, Homo Sapiens
aaaaaattatctttgccacttttacaactgwcattcacaaattattaaacatgctttaaaa

SEQ ID NO: 2522 - DNA, 61 bp, Homo Sapiens
taggtaatgatgcaatcgtaccacagaatamtttacctagtctggagggatgcattccact

SEQ ID NO: 2523 - DNA, 61 bp, Homo Sapiens
tcaacttggcaatagaggagcctagagttgrcctttgcatttgtggctggtgtattgtgac

SEQ ID NO: 2524 - DNA, 61 bp, Homo Sapiens
gcccacttggtatcttctaattgattagctratagtcacctcacacctaacatatgaaaac

SEQ ID NO: 2525 - DNA, 61 bp, Homo Sapiens
tctttgttttcgaaaaaaacctgatttaaawttgaattgcatgttcacaaatctcagtaat

SEQ ID NO: 2526 - DNA, 61 bp, Homo Sapiens
atctaaaataattaagtgactatcacttgtkgagcacctacatatgcaactttgtttcatt

SEQ ID NO: 2527 - DNA, 61 bp, Homo Sapiens
acagaaaggctacacagttttaaagctgctstaccaacttgggaatatgaggctttggccc

SEQ ID NO: 2528 - DNA, 61 bp, Homo Sapiens
gtacttcttttgaattgattacaatattgcrttgattgaaaatactggaattcaactttac

SEQ ID NO: 2529 - DNA, 61 bp, Homo Sapiens
tacatattcattcattgtcttttctgaaaayggatggccaagattctaaaacactcaattc

SEQ ID NO: 2530 - DNA, 61 bp, Homo Sapiens
aaataaaggccatgatatacagacaagtagrgttctaggcagttttaagaagacacaatcc

SEQ ID NO: 2531 - DNA, 61 bp, Homo Sapiens
attaggaaatctgttgggtatatgtagaagraaaaaaggaatccaacatttgttaaagagg

SEQ ID NO: 2532 - DNA, 61 bp, Homo Sapiens
cctgaatataagggctggaaggtttagaacraaaggcctgaatctgatataccagggtgaa

SEQ ID NO: 2533 - DNA, 61 bp, Homo Sapiens
ggcacgggacagagtattcagtattcgaatrtttctaaaggcttagtcagaattcttattt

SEQ ID NO: 2534 - DNA, 61 bp, Homo Sapiens
aaactgataaaggaaaagaatcaagcatttrttttactgtttctaaacaaattttatcatg

SEQ ID NO: 2535 - DNA, 61 bp, Homo Sapiens
ggacaacaatataagaatgttttctgatgcrcaatatgagcaaatacggttctagtcactc

SEQ ID NO: 2536 - DNA, 61 bp, Homo Sapiens
attgaaatgactggctgtctccatcgcaaasctgaataattgtagggctagaaatgagcta

SEQ ID NO: 2537 - DNA, 61 bp, Homo Sapiens
tagacaatcaaatctccaatactacatgacratcctaagcctgtatgtatctaacaacaaa

SEQ ID NO: 2538 - DNA, 61 bp, Homo Sapiens
aaggttgtattttagtaaagccattagggarggattttttgtgtattaaattccttcaatc

SEQ ID NO: 2539 - DNA, 61 bp, Homo Sapiens
caacccacctacaaagcacttttaaacttcrtcagacctgcattaacctattgtcaaccta

SEQ ID NO: 2540 - DNA, 61 bp, Homo Sapiens
aaagtttagagttcttgctcttataccaccrggatctcatgattagcatgcatttatcata

SEQ ID NO: 2541 - DNA, 61 bp, Homo Sapiens
atttgggactgcctatgttctgagctaaatrtacatctgtgaaatgaatgcatccattggg

SEQ ID NO: 2542 - DNA, 61 bp, Homo Sapiens
ttcagtcatagaaaataggaagataagtagkgagatcctcaatcagcatgtctttcattcc

SEQ ID NO: 2543 - DNA, 61 bp, Homo Sapiens
aattttaatatctctacgtaatccatatatmttttcccgcatatatattttactgtcaata

SEQ ID NO: 2544 - DNA, 61 bp, Homo Sapiens
ttatgaaaaaagaaatacagtttaatcttartcacattaccattaagaggttctttaaaat

SEQ ID NO: 2545 - DNA, 61 bp, Homo Sapiens
gaaattaacagtctcagacttcaaaagataytgcacatttctctttaacccagtccttaca

SEQ ID NO: 2546 - DNA, 61 bp, Homo Sapiens
cttccacctggctgcaattggatctgcgtgytaaccttttagtttcaacttgcagtggatc

SEQ ID NO: 2547 - DNA, 61 bp, Homo Sapiens
agttaccatacatatatgtatttccttgctytctcagatgagaatgcctagaagccatgaa

SEQ ID NO: 2548 - DNA, 61 bp, Homo Sapiens
gcgaaacatctctttgcatacaaaggtactrtgattcgatctccccaacgatttttaataa

SEQ ID NO: 2549 - DNA, 61 bp, Homo Sapiens
atggaatacagtgacacacttagccttataygccattctcttatttggataatgcagtatt

SEQ ID NO: 2550 - DNA, 61 bp, Homo Sapiens
gttgaaagcattacccctaagaactataacragacaagcatgcccacttttaccactccta

SEQ ID NO: 2551 - DNA, 61 bp, Homo Sapiens
tgtttctattccatggaccacctgcatccamatcatacatgagcttcaaagtacagattcc

SEQ ID NO: 2552 - DNA, 61 bp, Homo Sapiens
acagattccggagcctccagattaaagaatsatactgtttgagggtagagtcaggggagtc

SEQ ID NO: 2553 - DNA, 61 bp, Homo Sapiens
ctgcttacatactaactacccaagcctttgmtgcctagtactggcaacatggttaaacatg

SEQ ID NO: 2554 - DNA, 61 bp, Homo Sapiens
ttaagaaactcctaggtggaacagaattttrcctctatatcggtttttaccagacactgtt

SEQ ID NO: 2555 - DNA, 61 bp, Homo Sapiens
aactacattgtccttgtgtgtatctcattartccctgctcttctgtttaccttgggttctt

SEQ ID NO: 2556 - DNA, 61 bp, Homo Sapiens
taggtaattagaagagtcttgttactgcatytagtttagcatacataaatacagtaattag

SEQ ID NO: 2557 - DNA, 61 bp, Homo Sapiens
catctgattctggataatgataggatctagratatggaagtagtgatgagccttaaaatga

SEQ ID NO: 2558 - DNA, 61 bp, Homo Sapiens
taatcctaactccagtctgaggtaattgctrtgataattattcccattttacagataagga

SEQ ID NO: 2559 - DNA, 61 bp, Homo Sapiens
aaggagccaggttactaggtggtaactgtascatcaagttcactgtaacccttgtgtcctg

SEQ ID NO: 2560 - DNA, 61 bp, Homo Sapiens
taccatcatgattagatttctcagtgaggtrtagtatttaagaccattggacaatgtatca

SEQ ID NO: 2561 - DNA, 61 bp, Homo Sapiens
cctatggagattttgcccattaatggacttmaaaaaagacagcataccttttgtatgaata

SEQ ID NO: 2562 - DNA, 61 bp, Homo Sapiens
agaggagagagaaaaagacacagcaaaatasggtcagagagacaagaagagaacaaccaaa

SEQ ID NO: 2563 - DNA, 61 bp, Homo Sapiens
gaacaaccaaacagtatatttggcactgtarggagtaaaagattgagagattttttcccct

SEQ ID NO: 2564 - DNA, 61 bp, Homo Sapiens
cttgcagtcctggagcagtaacatgactacyttttgtggcaaaaaggctgctccttggtct

SEQ ID NO: 2565 - DNA, 61 bp, Homo Sapiens
aatctcagaaaaagatcacccgtaagcatartagtacaggggtagtctgaagtttgactaa

SEQ ID NO: 2566 - DNA, 61 bp, Homo Sapiens
gaccaagtctcacataaacttagtttgtacyctgtattaactgaaccatagaaccagtaat

SEQ ID NO: 2567 - DNA, 61 bp, Homo Sapiens
tctgttatgggctgagttgtgtgttcccccraaatattcacatgtcaaagtcctaacaacc

SEQ ID NO: 2568 - DNA, 61 bp, Homo Sapiens
ttcaagatatattgataaatgtaaaaatcartttgcagcactctatgtaaagtactatctc

SEQ ID NO: 2569 - DNA, 61 bp, Homo Sapiens
tttgctaatggaggaaatttatccttctacrctcatcttactgtgactcaaaactctcaaa

SEQ ID NO: 2570 - DNA, 61 bp, Homo Sapiens
tgatcaatctttgccaggttagtcatgaaaytgattcttctgaaaagctagatacacttcc

SEQ ID NO: 2571 - DNA, 61 bp, Homo Sapiens
aagcaaaagaatattggaggcaaaacaacaycatattcaagactcttctgatcttagacaa

SEQ ID NO: 2572 - DNA, 61 bp, Homo Sapiens
agcaatatgcatcttgatgtaaagatttgtyatggaacacaaccaaactcatttaaccagt

SEQ ID NO: 2573 - DNA, 61 bp, Homo Sapiens
acatgaggtattcaacacttcattaagaaayaggatttgtggagatgattttacctaactg

SEQ ID NO: 2574 - DNA, 61 bp, Homo Sapiens
taaatggctcaattgtttctgacacagatgktacgtagatcacgatttgagaagcatcaat

SEQ ID NO: 2575 - DNA, 61 bp, Homo Sapiens
gccattgttttctggttttaaactttattcrctagacatttgttaatttaatattttagaa

SEQ ID NO: 2576 - DNA, 61 bp, Homo Sapiens
agaaactgaattgtcagggtcgcatggctarcaagaagcaactcaaactctgactgtatga

SEQ ID NO: 2577 - DNA, 61 bp, Homo Sapiens
tcaaatttcgccggcattattcttgcaacartcttgccaaatcagtagtactactcctcgt

SEQ ID NO: 2578 - DNA, 61 bp, Homo Sapiens
ggccatcactttgagagaggagggaatgtaygtgagaccttgtatgcatttccaactggga

SEQ ID NO: 2579 - DNA, 61 bp, Homo Sapiens
ctgttttttctcagtgacgagttcacattcwccgtgtaatcaagcaaaagtaactgcaaat

SEQ ID NO: 2580 - DNA, 61 bp, Homo Sapiens
ggtgagtggctaaatatatgtggagtaaccrtacagtggaatattatttagtcataaaaaa

SEQ ID NO: 2581 - DNA, 61 bp, Homo Sapiens
aagcctcatccattttttttattcaattccwtcagaaacccagaaattaacctatatctat

SEQ ID NO: 2582 - DNA, 61 bp, Homo Sapiens
gcctcccaaactccagtagaggggttagatrtacaaattctgtctactcttcgcctatccc

SEQ ID NO: 2583 - DNA, 61 bp, Homo Sapiens
gagaatccaatgtgtttagatctgaggagtsgaaagaagggagaggcgtatttgccaggta

SEQ ID NO: 2584 - DNA, 61 bp, Homo Sapiens
ttactgcctctgcctaaaatgtccttcactrtgctaggtgccctcatcacctgcccaacac

SEQ ID NO: 2585 - DNA, 61 bp, Homo Sapiens
catcgtggctgttgagctggagggtctctgyggtctttccagatgtgctccccaatctgct

SEQ ID NO: 2586 - DNA, 61 bp, Homo Sapiens
gactcagagttaatcatcttgaaaagctcayagtggagcaggagaagcaaataggttacca

SEQ ID NO: 2587 - DNA, 61 bp, Homo Sapiens
gaaaggggcaccatcatgggatagtttttasatgaaaatttggaatgggggttaggacatt

SEQ ID NO: 2588 - DNA, 61 bp, Homo Sapiens
tagaccttggccatgcaatatgctgactctycttcttcatagcccttcatccatcagagaa

SEQ ID NO: 2589 - DNA, 61 bp, Homo Sapiens
aataatttttcaaaacacccacccagctgamgaaagtaacgggtaatgttattcaccagtg

SEQ ID NO: 2590 - DNA, 61 bp, Homo Sapiens
ccagcagctagaagctgtcagcaaatagcamcttttgtgggaagcacatctccatggctgc

SEQ ID NO: 2591 - DNA, 61 bp, Homo Sapiens
agtaagtgaactacctgatgattcattcatyggacaatagtcgatctgaggcaattacagt

SEQ ID NO: 2592 - DNA, 61 bp, Homo Sapiens
gacaagatcaagcctgtggtgtacctgtggytatgtgggatgaataagaaatagaggaaga

SEQ ID NO: 2593 - DNA, 61 bp, Homo Sapiens
aggataatcccattaagagcactcaggaatsgagggagagcaatgctccccacagcccagt

SEQ ID NO: 2594 - DNA, 61 bp, Homo Sapiens
tcttctcccctctcctaagacctgcatgackggtgacctcttaggaatttccaagtaagga

SEQ ID NO: 2595 - DNA, 61 bp, Homo Sapiens
ccaaaagcattcataaaagtaattatctcayagaaacattcactgtaaatacagtatatgt

SEQ ID NO: 2596 - DNA, 61 bp, Homo Sapiens
ctctcttttatcatccaccatgttccatatkatttgaaagtggcgaagatcattgtaactt

SEQ ID NO: 2597 - DNA, 61 bp, Homo Sapiens
gcaactaagtgattccttctttcacttggaygatgctataaaaggtggggcagccatgtat

SEQ ID NO: 2598 - DNA, 61 bp, Homo Sapiens
caatatgtagatagaaaaagtgctggaattrggagtgatgattactgaatgttggtggaat

SEQ ID NO: 2599 - DNA, 61 bp, Homo Sapiens
taaattagtcaaggctggaaaatggtggaamctagactaggacccatatcttccagagctg

SEQ ID NO: 2600 - DNA, 61 bp, Homo Sapiens
tttatatctgcattgaacagtatactttccrtacaactagattactaaatctaatttgttt

SEQ ID NO: 2601 - DNA, 61 bp, Homo Sapiens
cttggacacgacgaacttaaatgccatatgrtatctttgtgaggaatgacaatcaaatgga

SEQ ID NO: 2602 - DNA, 61 bp, Homo Sapiens
catgacagaggaggacagactgagtcacagytgacttttgaaataagaaagcattttccag

SEQ ID NO: 2603 - DNA, 61 bp, Homo Sapiens
aaacctcagatcttttgcagttcttcacaaygctgtcttgtcacccatgtgttcctagcac

SEQ ID NO: 2604 - DNA, 61 bp, Homo Sapiens
aaaccagcagtcctggattagcattactccrgagcagaaggttcactgtcaataaaggtac

SEQ ID NO: 2605 - DNA, 61 bp, Homo Sapiens
tatgggttttaacatgaaaaaccagcagtcytggattagcattactccggagcagaaggtt

SEQ ID NO: 2606 - DNA, 61 bp, Homo Sapiens
ttaaaatgtgaattacttaaaattacttaaratgtgaataaatttgtcaccatgaatacat

SEQ ID NO: 2607 - DNA, 61 bp, Homo Sapiens
tcagttgctcaaaacagaaacctggtgtcawccttgatcctaccctgcccctcatattgtg

SEQ ID NO: 2608 - DNA, 61 bp, Homo Sapiens
aaagctgtttagactgagagaacttctgtcytggataccattcatcatctcatttattttc

SEQ ID NO: 2609 - DNA, 61 bp, Homo Sapiens
tcattgtgggaagtgcatttgttctgctgargagtggtatatttctggggagttctgtgac

SEQ ID NO: 2610 - DNA, 61 bp, Homo Sapiens
ctgtttcctcgtaacttggctaaacaaatgratttataaccaattatgaggactcaataaa

SEQ ID NO: 2611 - DNA, 61 bp, Homo Sapiens
gggcagaaagcaaaggtctaacttaatgacrcacaaagagtcatcttttaccttcagctag

SEQ ID NO: 2612 - DNA, 61 bp, Homo Sapiens
ttatctcctatatcctaggattttgcgctgygccaagcatacagtagacactccattagta

SEQ ID NO: 2613 - DNA, 61 bp, Homo Sapiens
aatacaattttaaaattgtgtacatcttgcragttgccattttaagggctgtgtggaatca

SEQ ID NO: 2614 - DNA, 61 bp, Homo Sapiens
agaagcagttctggtctcaagatgatactaygttttagcagcttggctcacaaagagtgtg

SEQ ID NO: 2615 - DNA, 61 bp, Homo Sapiens
atcttttaccccacaagaactcaggaagtgmaacatgtccgaacaaacagtgaacaggcaa

SEQ ID NO: 2616 - DNA, 61 bp, Homo Sapiens
ccaccgtgccaggccaattcaattggttatyaatcctcactcacatttctccattttacca

SEQ ID NO: 2617 - DNA, 61 bp, Homo Sapiens
gcaagtcaaaggtcattcacactgtggtcgmgatgccactgtggcaacagcctggctgctg

SEQ ID NO: 2618 - DNA, 61 bp, Homo Sapiens
gagggaatggcaccatgggctaggaatctasagaaataaactgttttccttcctggttatt

SEQ ID NO: 2619 - DNA, 61 bp, Homo Sapiens
cctgttcagatgaaggtcaggattgctagamgcttttctgtcaactttctcctataatggg

SEQ ID NO: 2620 - DNA, 61 bp, Homo Sapiens
aaggagactttgttcctgcactgcaaatagraagggcacatactcaatcttcctgattcta

SEQ ID NO: 2621 - DNA, 61 bp, Homo Sapiens
aggatgctgggaggaagcaacaggatgtgcrgaaggagatggagaaaaccctacagcagat

SEQ ID NO: 2622 - DNA, 61 bp, Homo Sapiens
aaaaacagtaataaataattttggtgcacaytaagaataatttttaagagattttatactc

SEQ ID NO: 2623 - DNA, 61 bp, Homo Sapiens
ctgcaggctcctgatggggccaaggtggcaycattagtcttcttccacttttctggggctc

SEQ ID NO: 2624 - DNA, 61 bp, Homo Sapiens
cctacctccctcagctcacctgcggcaggtkatccctttctgtctgcttaggtagctcttc

SEQ ID NO: 2625 - DNA, 61 bp, Homo Sapiens
gactttgtttctgagtctgaagaggccgcaygtcggatctcagaactgaagagctacctaa

SEQ ID NO: 2626 - DNA, 61 bp, Homo Sapiens
acatttagtatacagttcagaatcactagawagacacacattgcttctgtatatacttgtg

SEQ ID NO: 2627 - DNA, 61 bp, Homo Sapiens
gcatttacaatataattttatgttatcgaartaatgtaaaatgtttgttgtacaggcatac

SEQ ID NO: 2628 - DNA, 61 bp, Homo Sapiens
atagaagtacaatagcctaaattagcatgayggtcttggaatataaatagtgggtcatagc

SEQ ID NO: 2629 - DNA, 61 bp, Homo Sapiens
tctccctataagttttcttttgcatccaagygaggtgcatgatatgtaggcaaggagggga

SEQ ID NO: 2630 - DNA, 61 bp, Homo Sapiens
tagagttaaatttgcaggattctgaaggacytctgtacttgtaattggccagacccaaaag

SEQ ID NO: 2631 - DNA, 61 bp, Homo Sapiens
ccaaatgttaaattaaatcaaggctactcgyggtctgctgctattgcccgccaggtttttt

SEQ ID NO: 2632 - DNA, 61 bp, Homo Sapiens
tactgtaatacaatgtccaaattcattcccygttcacactctagtttatgaatatacaaat

SEQ ID NO: 2633 - DNA, 61 bp, Homo Sapiens
aggccttcattgaccagtttttctttcttcrcatcctattcatttccttaatatcacatat

SEQ ID NO: 2634 - DNA, 61 bp, Homo Sapiens
tgatgaatgctacagtagaagttagggtttytttgagcattgccagggccttgatcttact

SEQ ID NO: 2635 - DNA, 61 bp, Homo Sapiens
aggcaaacagggtcttgagtggatcttgctsagtaggccaagcctcagcaaaccccaacag

SEQ ID NO: 2636 - DNA, 61 bp, Homo Sapiens
aggcaaggcaccagtcatactcacagaaaasgaagcacctgcctagtttccacggccaggg

SEQ ID NO: 2637 - DNA, 61 bp, Homo Sapiens
ttgcaaacttggtatgcaaacttgtgttaasagctctaaactggattaatctatcctggcc

SEQ ID NO: 2638 - DNA, 61 bp, Homo Sapiens
ataacatgcttctcatttttcttagacttgscatcatgcatatttaaatttacatttaaaa

SEQ ID NO: 2639 - DNA, 61 bp, Homo Sapiens
cctcccgaggccatggagcagcccaggctckctgaagaacaaagtcatcagaccccagcaa

SEQ ID NO: 2640 - DNA, 61 bp, Homo Sapiens
aaaaaaaaagaaaaaaaagaacagtccagawgtaataactttaatgaaatgagagcaaggt

SEQ ID NO: 2641 - DNA, 61 bp, Homo Sapiens
tgaggaaagcaaaacattttcaggttgataygtcatgcttcttcatgcttataaattatat

SEQ ID NO: 2642 - DNA, 61 bp, Homo Sapiens
agtgaatgtggtagatacattacacagattwtaaaatgtgaggaaagcaaaacattttcag

SEQ ID NO: 2643 - DNA, 61 bp, Homo Sapiens
tctatttttttaaacaactcatttttaaccrtcttggtgaaagagacaaggacgtaaattg

SEQ ID NO: 2644 - DNA, 61 bp, Homo Sapiens
aaaaaaaaatgcaattgacaaggtggcttaragaataagcatttctctctcacagttctaa

SEQ ID NO: 2645 - DNA, 61 bp, Homo Sapiens
gagggttctcttcctaatttggaaacggctrtttttttgctgtttactcacatggctgaga

SEQ ID NO: 2646 - DNA, 61 bp, Homo Sapiens
tcagtgatctcaaggagcatatttacacagrtagtcctaaaattgcatatgacaccttgac

SEQ ID NO: 2647 - DNA, 61 bp, Homo Sapiens
gcagtagcagcccctaattcctagcatcttsgagaaagactagttctcaagaatttgaaac

SEQ ID NO: 2648 - DNA, 61 bp, Homo Sapiens
ccagatcctttaaaatatgcaattaagagtraaatctacacttttggtcactttttatttg

SEQ ID NO: 2649 - DNA, 61 bp, Homo Sapiens
gtcactatgtatagtaatttatttaaggagrccctattgaaggatagtgaagtttttgtca

SEQ ID NO: 2650 - DNA, 61 bp, Homo Sapiens
aaacatgcacccaacccagccttggatgccrccaccaggtttttgaagcccttttgagtct

SEQ ID NO: 2651 - DNA, 61 bp, Homo Sapiens
agtccattggtagaatggatactctgtttcygtcttttccctgagttctaaaacacttcaa

SEQ ID NO: 2652 - DNA, 61 bp, Homo Sapiens
cagttggatgtcacacctccagagaatatcraaactactggttcttcctaaatgtatactg

SEQ ID NO: 2653 - DNA, 61 bp, Homo Sapiens
cccaggggcataaatcatctcttaccctacrtcacttgtttccttgactgctttgactttc

SEQ ID NO: 2654 - DNA, 61 bp, Homo Sapiens
cagaaacttaattctgtcctcccgcctgcarttcatggatcctaaatgtgaaagaaaacaa

SEQ ID NO: 2655 - DNA, 61 bp, Homo Sapiens
tgagagggaaagaaaaaaatcaaggcaccasaattctaagcatggaatattgacaagcaga

SEQ ID NO: 2656 - DNA, 61 bp, Homo Sapiens
tgggtgtgagagttcccttctactaaccacrccatcatcaatgttgagtaatatcaggatt

SEQ ID NO: 2657 - DNA, 61 bp, Homo Sapiens
tgtctgaggcattcatcatcgtctggggagraagaatcatgcataatttctgggctatgat

SEQ ID NO: 2658 - DNA, 61 bp, Homo Sapiens
ttcattcctttttttcctttcctttcattcyaggggacaaggctactcctaccacttccct

SEQ ID NO: 2659 - DNA, 61 bp, Homo Sapiens
tccaaattcaatcatctgagcataccgcacyacctagctttcttcagccttgccatgttct

SEQ ID NO: 2660 - DNA, 61 bp, Homo Sapiens
taataagattgctctgaggattaaatgagckaatgcacctactatacagagtattacttgt

SEQ ID NO: 2661 - DNA, 61 bp, Homo Sapiens
taggagttttgatatcatagtaaataatgaygtaggcagagacattgaagatgcacactaa

SEQ ID NO: 2662 - DNA, 61 bp, Homo Sapiens
aaataaatgtactgctcattgtagatttcaytttcaaaacagataacaatgcccagtgagt

SEQ ID NO: 2663 - DNA, 61 bp, Homo Sapiens
aatcaggcacaggtatagattatttccaccrtaacacctgagtagccacttgcccaagacc

SEQ ID NO: 2664 - DNA, 61 bp, Homo Sapiens
ccactatgcacacaaatgctttcctctctaraccacgcggctcacttgtttaccccaatgc

SEQ ID NO: 2665 - DNA, 61 bp, Homo Sapiens
aggtcctgggctccagcccaatgttttctayggcatatttcaaggagagctgcaaagtgtc

SEQ ID NO: 2666 - DNA, 61 bp, Homo Sapiens
ttcacaagaattgctgctggcattaacctgrcactttgcagctctccttgaaatatgccgt

SEQ ID NO: 2667 - DNA, 61 bp, Homo Sapiens
atatttattaagcagccaaccactattcagrcagtttacccacaatgcctcacttactctt

SEQ ID NO: 2668 - DNA, 61 bp, Homo Sapiens
cttcctgaacacgtgagaataaaaagttacstggattacgtggattttgacaatgtaaaaa

SEQ ID NO: 2669 - DNA, 61 bp, Homo Sapiens
gaagggtaaagttaactttctaagacatacragaggagttgaaattagatgtgaatctaga

SEQ ID NO: 2670 - DNA, 61 bp, Homo Sapiens
gtcgtctcaaactcctgagctcaagcaatckgtcggcattggccttccaaactgctggaat

SEQ ID NO: 2671 - DNA, 61 bp, Homo Sapiens
gatggagttgctctgacaaatgcctctgacraaaggactcttgaactcattgaagtctacc

SEQ ID NO: 2672 - DNA, 61 bp, Homo Sapiens
ctgtagcggagtttatgacctttcttttgargacatctttacggttgatattccttgctag

SEQ ID NO: 2673 - DNA, 61 bp, Homo Sapiens
aaaatacaggagtaatgaagaccttccatgsaaaatgagcaaaggagagcaaaccattgag

SEQ ID NO: 2674 - DNA, 61 bp, Homo Sapiens
ttagacattttcctcttcctggtgcagagarggagacattcctaccaatagggatgtcctg

SEQ ID NO: 2675 - DNA, 61 bp, Homo Sapiens
ctccctctgctcctcacacctgcccaggagrgttacttctcaaggtcttgtgccagccatt

SEQ ID NO: 2676 - DNA, 61 bp, Homo Sapiens
tgagatacctcagtcctgtggatacctcagkcaggcttaaaatgtggcacaaattctcttt

SEQ ID NO: 2677 - DNA, 61 bp, Homo Sapiens
ataatgagcctgctttaatgtgatccaaatrttcatgggaaactctaaagcagttttgaag

SEQ ID NO: 2678 - DNA, 61 bp, Homo Sapiens
gttaggctctatgatctggtgacaatagtcsttactgttagaggtgaatccttgtaaagtt

SEQ ID NO: 2679 - DNA, 61 bp, Homo Sapiens
acacggtgctgggcatccttgcatacatgasggatcagaaaaccagcaatccaggcaactc

SEQ ID NO: 2680 - DNA, 61 bp, Homo Sapiens
cttaatctgcctatatgcttttcaaaattcrggaaccaaaggacttagttttcactatata

SEQ ID NO: 2681 - DNA, 61 bp, Homo Sapiens
catctccccaggcctttgctacaggttttcyagccctggacggttcaggaattgccctacc

SEQ ID NO: 2682 - DNA, 61 bp, Homo Sapiens
gggattgaaaggggcagagctaaggagagcyatgtaggagtttttatggtccaggtctgga

SEQ ID NO: 2683 - DNA, 61 bp, Homo Sapiens
cagtgtttctccaaatatggtccatagaccrcctgcaaagaatcacctgggtgtgcttgga

SEQ ID NO: 2684 - DNA, 61 bp, Homo Sapiens
tcctgggagcttgtgccatgtcatgccttckctaaaaaaggtctaggcaagaggcgtcaag

SEQ ID NO: 2685 - DNA, 61 bp, Homo Sapiens
ccccaatattttaagctcatactcttacaaygagtccctgcatgtggaggtgggagtcctc

SEQ ID NO: 2686 - DNA, 61 bp, Homo Sapiens
agatcctttggaagtcatgagcatctaagtyggtgagctaaacattaggatattaaccaga

SEQ ID NO: 2687 - DNA, 61 bp, Homo Sapiens
ccctcgatcactaggacgagcttaaaacagwgcagaaacctctgatagatactggaaggat

SEQ ID NO: 2688 - DNA, 61 bp, Homo Sapiens
catataaagccagacatatctctcttgactsatgttacacagctcctttctataccgtttc

SEQ ID NO: 2689 - DNA, 61 bp, Homo Sapiens
tttctttataaactacccattctcaggtagytctgtgtagcaacagactaatacagtcatt

SEQ ID NO: 2690 - DNA, 61 bp, Homo Sapiens
taatattcactataagtaacataatgaatcytcatgtgcccaaaacccattttcttttttt

SEQ ID NO: 2691 - DNA, 61 bp, Homo Sapiens
ctatatatgatatgcatgccagtggagttgraggaactagaaaatttttatctggagatga

SEQ ID NO: 2692 - DNA, 61 bp, Homo Sapiens
ccaaaaacagatacttgggaaccactcttaygaagcacagtgattattcttgaccatagac

SEQ ID NO: 2693 - DNA, 61 bp, Homo Sapiens
gtgtgatttctctataaatgatttgtataayggtttgggaaacacataaatgttaggggtg

SEQ ID NO: 2694 - DNA, 61 bp, Homo Sapiens
ttatataacagctcaggaccaagaagttagygttgaatggttatgttcacatgtggtccaa

SEQ ID NO: 2695 - DNA, 61 bp, Homo Sapiens
ttaggacttgggcttacatagcaccttaacraaagatcaatatatttttaaagaagtgaca

SEQ ID NO: 2696 - DNA, 61 bp, Homo Sapiens
gtggcttgtttggggatgatagttaagtackgctggttttgaacctgggaagtctggttat

SEQ ID NO: 2697 - DNA, 61 bp, Homo Sapiens
tacacagaataagcaagtttatagatagacwgtagaatagaggctgccgcagtggggcgag

SEQ ID NO: 2698 - DNA, 61 bp, Homo Sapiens
aacttcccactcctatggaggaaaatgatcrgtaaaaatgcatttttcactctgttgccat

SEQ ID NO: 2699 - DNA, 61 bp, Homo Sapiens
gctaaataaatgatagctattatcattagaktagacactgaacttagactatggtaatggc

SEQ ID NO: 2700 - DNA, 61 bp, Homo Sapiens
gttctgcctgagggtctcacactccttcttyagctacaggtgtgacaataagcaaggaggc

SEQ ID NO: 2701 - DNA, 61 bp, Homo Sapiens
gttctccttttccagctcatggactttatcrccccgggcccgagcagcagtcagctgttcc

SEQ ID NO: 2702 - DNA, 61 bp, Homo Sapiens
ctgcagcataacttcagtgatgtaggtggaytctggcaatatcataaatattagtaaaaat

SEQ ID NO: 2703 - DNA, 61 bp, Homo Sapiens
ggaggcggcagcagcaaagtcccaagaacamagtgctggtgtaggagtcaggcccgcatct

SEQ ID NO: 2704 - DNA, 61 bp, Homo Sapiens
ctgaaaggttcttcaaagtcaggtccctaasaaagctgttccatctccagctcagcgtgtt

SEQ ID NO: 2705 - DNA, 61 bp, Homo Sapiens
gccccagaagagaagaggcttctttctcacygtgaggcagaaacaaatttatctgtatgta

SEQ ID NO: 2706 - DNA, 61 bp, Homo Sapiens
aagcagcctccctctgttactactataaacrcccattctgcaggcagtgtgagggcacagc

SEQ ID NO: 2707 - DNA, 61 bp, Homo Sapiens
ggtggaagcaccccacttcctttacctggtstcccatcacctatcagaaccagagagcgca

SEQ ID NO: 2708 - DNA, 61 bp, Homo Sapiens
cctcctgtgggaaaaccgtgacagtgacgayactgatggacacacatcagaattcccgaca

SEQ ID NO: 2709 - DNA, 61 bp, Homo Sapiens
cagaatgaggaacaatctatgtaaagcaccyggtacagcctaagtgttcaatgaaaagtgg

SEQ ID NO: 2710 - DNA, 61 bp, Homo Sapiens
ggactacaggtgtgcaccaagatgcttgacraattttctaatttttttgtgtggagaaggg

SEQ ID NO: 2711 - DNA, 61 bp, Homo Sapiens
ggagaaatatactactggttcatgcaacagytcaggtgaatctcaaaagtgttatgctgag

SEQ ID NO: 2712 - DNA, 61 bp, Homo Sapiens
ggagctcctcgctgttttccagggaggattyggcttctaggtggctttgcaaccagcaggc

SEQ ID NO: 2713 - DNA, 61 bp, Homo Sapiens
cgtggtaacactcttagaagatgcagataamcttttcccagaatcagattgttcctcgagc

SEQ ID NO: 2714 - DNA, 61 bp, Homo Sapiens
atctgtgcataagggcaggcggtcacaggtsggtaacttcgaggggactccagggccctcc

SEQ ID NO: 2715 - DNA, 61 bp, Homo Sapiens
gcctccctttctcccaggagaaggatatcaygcccgacccaaagctgctggagaaggtgag

SEQ ID NO: 2716 - DNA, 61 bp, Homo Sapiens
atttatgagataagtggaaatctgaacacasactgggtatttaacagtattaggaaattag

SEQ ID NO: 2717 - DNA, 61 bp, Homo Sapiens
ctgaacagtggggctgctcggtgtgacctcyttggtactggcaggacctcatggaaaccaa

SEQ ID NO: 2718 - DNA, 61 bp, Homo Sapiens
gattttagtaatttaataatcctcacccagwtatctcagataaacaaaatcctcttgttgg

SEQ ID NO: 2719 - DNA, 61 bp, Homo Sapiens
ctttccatagaaaaatcaggaaactgcgtgkcaactgttgcagaaacacaaagacgatgca

SEQ ID NO: 2720 - DNA, 61 bp, Homo Sapiens
ttattggcaaactatggaagagttttaagcratgtagtgagctgctgagatttgtcttttt

SEQ ID NO: 2721 - DNA, 61 bp, Homo Sapiens
cttctgtcttgaattcctgagaggtttggawtcagtggctcccgaggtgcttcactcctaa

SEQ ID NO: 2722 - DNA, 61 bp, Homo Sapiens
tatgatgcactctaagcactgtggctccaamgagacagaagagcatctaagtctgaggcca

SEQ ID NO: 2723 - DNA, 61 bp, Homo Sapiens
aaaagttaaagtgtcctggtcatatgtcctycttcaaataaggttcaggtcaggtgtggtg

SEQ ID NO: 2724 - DNA, 61 bp, Homo Sapiens
attggaggctttcaagtcgtgaaatgatgcratctcaggtttttaaaagactctggctact

SEQ ID NO: 2725 - DNA, 61 bp, Homo Sapiens
acacagatgggtatgggactctgggccaaaytgatgcttctccaaacgatttctactcttt

SEQ ID NO: 2726 - DNA, 61 bp, Homo Sapiens
tttcctctctcttttttctgagtctctggtwatagcccctagtcttttttttttttttttt

SEQ ID NO: 2727 - DNA, 61 bp, Homo Sapiens
gaaagtcagttccttgtctctgttcttaacrccaggcctttccaccgtatcggcaattttg

SEQ ID NO: 2728 - DNA, 61 bp, Homo Sapiens
tttcttagttctctcaccctccattcacctractcagccttttgcccattccaaccctgct

SEQ ID NO: 2729 - DNA, 61 bp, Homo Sapiens
ggtgggcactatgcattgagaaactagcctwcatcaggccgttgttcctgttgtgccaggg

SEQ ID NO: 2730 - DNA, 61 bp, Homo Sapiens
gtctgatccggtgatcatgttttcttttccytttgtgtaatgcctacaggaaccttgtcaa

SEQ ID NO: 2731 - DNA, 61 bp, Homo Sapiens
ggatgatggattaacactgcagagatgccarcgtgaggagtcccaggctgctcggatcatc

SEQ ID NO: 2732 - DNA, 61 bp, Homo Sapiens
ctttcgtatgtatttgtgaataacagaagayacaatgacatggtgatggtaacacatgttg

SEQ ID NO: 2733 - DNA, 61 bp, Homo Sapiens
tcccctctgttggttctctcagcagcacggrggacgatgaagaggaagaagaaatcgtgca

SEQ ID NO: 2734 - DNA, 61 bp, Homo Sapiens
tggtccaaaagttcagaagtgttttgatcaygtgggaatcagaaagaatgttcctcttatg

SEQ ID NO: 2735 - DNA, 61 bp, Homo Sapiens
tccagatggagttctagcaaatcaggtctaycaggtattaatcacagctgtctattttcag

SEQ ID NO: 2736 - DNA, 61 bp, Homo Sapiens
gaaggatctgtctgtgcatcaagtgttggcamtggattatttagcccaactctcttattca

SEQ ID NO: 2737 - DNA, 61 bp, Homo Sapiens
tctcaatttcctgtgcactgaagcacccgtygtatggtgtataaagatattgggaacacta

SEQ ID NO: 2738 - DNA, 61 bp, Homo Sapiens
taaaccacaagagaaagagaaagagcttacragcaagcgcacttgtgtgtgtgtagatatg

SEQ ID NO: 2739 - DNA, 61 bp, Homo Sapiens
aagtgcctgtcagagtacctggcactttagyaggggctcagtaaagagtagggaggaagtg

SEQ ID NO: 2740 - DNA, 61 bp, Homo Sapiens
gtggaggaggatcactggtagccgtgtaagwggtgctaagtttggacaactaggcagttaa

SEQ ID NO: 2741 - DNA, 61 bp, Homo Sapiens
aatctgtctgctgaaaattttcctgttgccsttattatatttgctttgcagcagtgacgaa

SEQ ID NO: 2742 - DNA, 61 bp, Homo Sapiens
tgaaataaagagtcatcctgtaaatttaaayaggagtgcctctcactgattaaaagctgat

SEQ ID NO: 2743 - DNA, 61 bp, Homo Sapiens
gaatatgcagattcttcctccagactatttytcatacttatctcctcacttccatttccat

SEQ ID NO: 2744 - DNA, 61 bp, Homo Sapiens
catgtactctttccaggccagacccagtttygaatgtatcttttttagaaggaaggggttg

SEQ ID NO: 2745 - DNA, 61 bp, Homo Sapiens
ggcactgcgcccggtggtggttttacagtcyatagatccctatgtgaataaagatagttgt

SEQ ID NO: 2746 - DNA, 61 bp, Homo Sapiens
aaggctgagttaattaaaattcagcactggrcctctttcaaaagcctggcattgcaatccg

SEQ ID NO: 2747 - DNA, 61 bp, Homo Sapiens
cattcaatcatttattgatatcagtatagaygtatgggcatttatgttatactctggggta

SEQ ID NO: 2748 - DNA, 61 bp, Homo Sapiens
tgctcctggaatatttacataaagctgtttytctagcctttccaataattttgtaagtcat

SEQ ID NO: 2749 - DNA, 61 bp, Homo Sapiens
attatttcatccctgaatcttcagcctgaamaaatatgaatgctgataataaaacattgaa

SEQ ID NO: 2750 - DNA, 61 bp, Homo Sapiens
aagccaaaattgagattgaaattacaaaagraggagaacaatcatcaagcagccaatccag

SEQ ID NO: 2751 - DNA, 61 bp, Homo Sapiens
ttttctctgtgactacaatggcaaattgatkagataaaacttattaacatgcaatgccaaa

SEQ ID NO: 2752 - DNA, 61 bp, Homo Sapiens
aatagtatagacaaaagtttcccatttaagstcgatatcctctctctcacctaaaatagct

SEQ ID NO: 2753 - DNA, 61 bp, Homo Sapiens
aactgccctttgtcaagtaaagaactttacwagctcatcaagtgatatcaacatctttgga

SEQ ID NO: 2754 - DNA, 61 bp, Homo Sapiens
aaaaaaaaaaaaaattaaattctccttgcaytcctccaagtaccttatttcttttctcccc

SEQ ID NO: 2755 - DNA, 61 bp, Homo Sapiens
attgtctggcagtttctgagggtacaaatcrgggagagaaagccctctttctgcagtattt

SEQ ID NO: 2756 - DNA, 61 bp, Homo Sapiens
agtagcagacccctaggttggcaagtatagstaaggtaagcgcagctggcaaggtgtgacc

SEQ ID NO: 2757 - DNA, 61 bp, Homo Sapiens
gagtgacaaagtcagtattcaagctcagttwatccaattccagagcctgtaatctcaattt

SEQ ID NO: 2758 - DNA, 61 bp, Homo Sapiens
ttgcatcttttggaacacccactgtacttcyttttcattaccttcttctacctaggatgtt

SEQ ID NO: 2759 - DNA, 61 bp, Homo Sapiens
aaagacccatttcccatgtcagagaggctcytggagaaagaaaggaatacaaaaatccctc

SEQ ID NO: 2760 - DNA, 61 bp, Homo Sapiens
atagatatagagcatccagcatactgcagayaccgtccgcgtgagagttttccagttgttt

SEQ ID NO: 2761 - DNA, 61 bp, Homo Sapiens
gacttcctgctgcatcttcacatagtagaargggcaagtgagctcccttgagcctataagg

SEQ ID NO: 2762 - DNA, 61 bp, Homo Sapiens
cccttagataactttctgtttatggaaaagkgatcagcgtggcatgcaactcaaaaataac

SEQ ID NO: 2763 - DNA, 61 bp, Homo Sapiens
atcagccactccttatgagtatggatcttgygattttagaactccaagaaaattcttaaca

SEQ ID NO: 2764 - DNA, 61 bp, Homo Sapiens
ttaatgtgaggtgatggttgccgtctgtatmtataaactcaaccaggtcttggcattgagg

SEQ ID NO: 2765 - DNA, 61 bp, Homo Sapiens
tgggactacatgcctggctcctgggtgcccktttgtgacagtcatctcacccaagagcaat

SEQ ID NO: 2766 - DNA, 61 bp, Homo Sapiens
tttaagtattttaacctttattgtaacatayagcacagaacaaagagccacatagaacaag

SEQ ID NO: 2767 - DNA, 61 bp, Homo Sapiens
tctgcctttttatttcatttatgcaatatcrtctcatttaggaataaaaactccaggctct

SEQ ID NO: 2768 - DNA, 61 bp, Homo Sapiens
cattgtctcatttcaattataacctcttcamatccaggaagaatatttgccacttatggca

SEQ ID NO: 2769 - DNA, 61 bp, Homo Sapiens
aggcccgtaccccaaatgaccgattttggawatgtccgactccaggagcgagaagggtgca

SEQ ID NO: 2770 - DNA, 61 bp, Homo Sapiens
tggaggaagagaacagattctggcaggtgtsttttgcttctggagtctactgaacaggggt

SEQ ID NO: 2771 - DNA, 61 bp, Homo Sapiens
tctgacaagacacttttggctaaaacaagcrttaggattgggagaatgtttctcagtggaa

SEQ ID NO: 2772 - DNA, 61 bp, Homo Sapiens
agggcctcactgcacagttgaattttagggmatctgatctgagttgattctgcgtctttat

SEQ ID NO: 2773 - DNA, 61 bp, Homo Sapiens
aatttaggctgagttagttttctgtagctgytctttctttctaaggcactggctgccagat

SEQ ID NO: 2774 - DNA, 61 bp, Homo Sapiens
gaaaatgcatgttgttatctcactttgaggsattgttttcttggttgatttggtttacagg

SEQ ID NO: 2775 - DNA, 61 bp, Homo Sapiens
tgcaggaagaaaccaatagttttctgaaagygattgaagaagccaataaaaagatgcaagc

SEQ ID NO: 2776 - DNA, 61 bp, Homo Sapiens
attccagaccttttggtattctgccgttgayttcagatattttattgtgttgctggacccc

SEQ ID NO: 2777 - DNA, 61 bp, Homo Sapiens
ggggttgttttaaaatactccagaaaaaaaytgtgggagtaagtgagacaagaacagcata

SEQ ID NO: 2778 - DNA, 61 bp, Homo Sapiens
agcatttagcaactctatactattcaccaayattatcttgctttatgttttcaacctataa

SEQ ID NO: 2779 - DNA, 61 bp, Homo Sapiens
tgcagactgcctatcatgggacttttcagtmtgtataatcgtgtaagccaattcccctaat

SEQ ID NO: 2780 - DNA, 61 bp, Homo Sapiens
atgtaagcagggctgctttcgacttcttaamgtcacaagtaacagaggttttttttcttct

SEQ ID NO: 2781 - DNA, 61 bp, Homo Sapiens
ccacgctgagtcgtacaggcatttacatagraacttggagcaaatggacacttcctctcag

SEQ ID NO: 2782 - DNA, 61 bp, Homo Sapiens
ttgacaaccaggtcaaatttcaaaagaatgyatggtttaaacaaaacacatccaggaacca

SEQ ID NO: 2783 - DNA, 61 bp, Homo Sapiens
ctgcgtcacactgaggagtcaagacgctatyctgtcagccaggggctttcctagccagggg

SEQ ID NO: 2784 - DNA, 61 bp, Homo Sapiens
aggctggtgtgtgaggttcctaatctcccartcacagaagaaattatgttcaagacagctc

SEQ ID NO: 2785 - DNA, 61 bp, Homo Sapiens
ctgcgccagagctctcagcacactgagtcaraccattccactgaatagaattctggtctac

SEQ ID NO: 2786 - DNA, 61 bp, Homo Sapiens
ggaaaatgggcaagcagagtgcacagccctygttctgccagctggagccaagaagcacaga

SEQ ID NO: 2787 - DNA, 61 bp, Homo Sapiens
gggagggggcgtaatggtcacaaaaggaagraaacacaagaggccgaaggagtcctcacta

SEQ ID NO: 2788 - DNA, 61 bp, Homo Sapiens
actgtcgtcatgcattcttgccaagctgccyacagtgaactgactgctggatactccctca

SEQ ID NO: 2789 - DNA, 61 bp, Homo Sapiens
agcaaaacagagatgacagaaaaaaatcatygcactgtagttcagtaagaattactgaatt

SEQ ID NO: 2790 - DNA, 61 bp, Homo Sapiens
tttttcctggttaatcttctttaatttttgyccactgctatttttacaacatgatttttat

SEQ ID NO: 2791 - DNA, 61 bp, Homo Sapiens
ctcgagatctaaatgcaagtccagtggataygctcttctgatttcccttctttaaatgggc

SEQ ID NO: 2792 - DNA, 61 bp, Homo Sapiens
atggttttacagagcaggaatttcagtttcyttctgttggactttttaatcagtttccaga

SEQ ID NO: 2793 - DNA, 61 bp, Homo Sapiens
ttaaaggtacagagtgatatattttaatctytcttggacagcaagactcctcttcactagt

SEQ ID NO: 2794 - DNA, 61 bp, Homo Sapiens
tgacttagacattgctggtgcagagatgacsattgtgcaaacctgatggactcatggaatc

SEQ ID NO: 2795 - DNA, 61 bp, Homo Sapiens
tccaggcttctaagctggcctccacacactrggaagcacagagtctccaaaatacaatctg

SEQ ID NO: 2796 - DNA, 61 bp, Homo Sapiens
acagagggcatgacattcttttagtcaaccwatttggatgtcaccaacacctgatgacagg

SEQ ID NO: 2797 - DNA, 61 bp, Homo Sapiens
tgtgagcatggacaggctccatgctctcagwgtgaggctgaaggaacttctacatttgctg

SEQ ID NO: 2798 - DNA, 61 bp, Homo Sapiens
agggtggtatgtttctcttgttggctttaaytgttgctaaaatcgaaaggaaaaatattct

SEQ ID NO: 2799 - DNA, 61 bp, Homo Sapiens
gtttgaatatctggtcctgctggtattggarcagattgccagttttttattgctgtgccat

SEQ ID NO: 2800 - DNA, 61 bp, Homo Sapiens
actgtgaatttagaccaagcagtgatttcakagtggaagatggaacaggatgtttagtggg

SEQ ID NO: 2801 - DNA, 61 bp, Homo Sapiens
tacacaaatttgtggtatatctgtggtattraagtttcatgaagtgaggagtgagtagaga

SEQ ID NO: 2802 - DNA, 61 bp, Homo Sapiens
gatttccctcactgagtgaatacagaagcamactataatatatccatacagtggaatacta

SEQ ID NO: 2803 - DNA, 61 bp, Homo Sapiens
cagagcacgtgacatttcattttcctctgartggacttctaggcaatcaggtttttcctta

SEQ ID NO: 2804 - DNA, 61 bp, Homo Sapiens
tagttttccatatgcaagttggtgctacacwcagatttgtcataaaaagtcaatagtgaaa

SEQ ID NO: 2805 - DNA, 61 bp, Homo Sapiens
catgaggcttgtgccctttaatttgcaagaraggaactggagtccccaaagagctagcatg

SEQ ID NO: 2806 - DNA, 61 bp, Homo Sapiens
aattatctgcatgtaagtcactggacagggwtagggtagaaaagcttttttgttgttgttg

SEQ ID NO: 2807 - DNA, 61 bp, Homo Sapiens
gatataatttttcagtcctctccatgagtcragtggtattatccccatgtttgcagatgag

SEQ ID NO: 2808 - DNA, 61 bp, Homo Sapiens
gattagaaaaacagacaaacttgtagcattrtttctaagctgggatctgttttttaaaaaa

SEQ ID NO: 2809 - DNA, 61 bp, Homo Sapiens
ccctcctaccatggtctagcctggtgtacgsaaaagagtaggtactcaaatatttactgga

SEQ ID NO: 2810 - DNA, 61 bp, Homo Sapiens
tgtcctgaaaattgaaaatcatttatcactrtgactgaggtcttgctctcatctaagtctt

SEQ ID NO: 2811 - DNA, 61 bp, Homo Sapiens
cttaagcactgtccacacacactgtttttgsggggagtgaggtctcgtttcatttcctgta

SEQ ID NO: 2812 - DNA, 61 bp, Homo Sapiens
actggagaattagactttcagaaaagaaaaygctttcagaacttcttcacgttcaatatac

SEQ ID NO: 2813 - DNA, 61 bp, Homo Sapiens
gttaagaagaaaaccactttaagagcaatamggaaatattaaaatcacgaagaaatgtata

SEQ ID NO: 2814 - DNA, 61 bp, Homo Sapiens
gatgtcatgcttttctgttgttcaagtaaayctggttgttttgtttcttcttacctctgtt

SEQ ID NO: 2815 - DNA, 61 bp, Homo Sapiens
ggcaggtactgtcactccattaagacttatrttctaggtaatgacacacacacagtcccta

SEQ ID NO: 2816 - DNA, 61 bp, Homo Sapiens
caaagccttaagatatcctctcaaatgtcartttttcctttctttgctccttggggaaaat

SEQ ID NO: 2817 - DNA, 61 bp, Homo Sapiens
ctgtttctggtgccttcctcggggtcctgayacctgccctttctgatacacgtgcaatcca

SEQ ID NO: 2818 - DNA, 61 bp, Homo Sapiens
ctggtcatttcaggcactgagaaaaggtgcygtttcattctcctaagagagtttggtgagt

SEQ ID NO: 2819 - DNA, 61 bp, Homo Sapiens
ttggagagcacaagaatttcatatctttctygaaactgttaagtatattttcttacacata

SEQ ID NO: 2820 - DNA, 61 bp, Homo Sapiens
gtaggtgccaatatcctgcctctggcggctscagtaggagaacaaagcaagtgtggggaag

SEQ ID NO: 2821 - DNA, 61 bp, Homo Sapiens
acatgtgagctctcagcagaatgtggttacmgtaggaaagggggctccttgggatgtgcta

SEQ ID NO: 2822 - DNA, 61 bp, Homo Sapiens
tgaatttcttcctgattcactgggtagtttktacagatgaaatgtgatcacagctgccaat

SEQ ID NO: 2823 - DNA, 61 bp, Homo Sapiens
tgtggtttattgagtaacacttaatacttarcacagccctcagtgaagatcttttatggcc

SEQ ID NO: 2824 - DNA, 61 bp, Homo Sapiens
ccattccactttctgtctgtaaatttgactrtctggatacctcatgtaagtggactcgtac

SEQ ID NO: 2825 - DNA, 61 bp, Homo Sapiens
ctggtgggagaattttgagaaagtcacccarttgctcttaagtcctcatttttttttttaa

SEQ ID NO: 2826 - DNA, 61 bp, Homo Sapiens
gtggcccagtagcgacgaaagtgcaagtggrttggtgactgaaaaatatctgcgatcatgt

SEQ ID NO: 2827 - DNA, 61 bp, Homo Sapiens
actgcaaggagtttggctttcacattcccartggatgagagaaaaattggcaattgtttct

SEQ ID NO: 2828 - DNA, 61 bp, Homo Sapiens
ctgatttgtagcctgaaggatgagattaaastcacccactcaaagaaccagggagagagct

SEQ ID NO: 2829 - DNA, 61 bp, Homo Sapiens
tttactaaacgttgaaaatgagatgttagtygtactttcctctttcatttatttttgggaa

SEQ ID NO: 2830 - DNA, 61 bp, Homo Sapiens
gtcctccaagccgttctcaaatcccacatcwttgttctgccctgttttcctcccccacggt

SEQ ID NO: 2831 - DNA, 61 bp, Homo Sapiens
gctggtgggaaatcgagcggcataaggcttytctgacatctcctgatgtgaacactgtgaa

SEQ ID NO: 2832 - DNA, 61 bp, Homo Sapiens
gcctctgttgcagcgactcaactcttgttayagcttgaaagtagccatagactactgtaca

SEQ ID NO: 2833 - DNA, 61 bp, Homo Sapiens
gatcttgacttaaatttgatcaagatacagsaattgggtggttagttttgcttgcacaatg

SEQ ID NO: 2834 - DNA, 61 bp, Homo Sapiens
atacatatgacagataaggagtcactagagkatgcttttgctttgtgtcagacagatatta

SEQ ID NO: 2835 - DNA, 61 bp, Homo Sapiens
acccatatagaatagactaaggaactaccatycaggagtggtccaccagtccagtcactgg

SEQ ID NO: 2836 - DNA, 61 bp, Homo Sapiens
atagagtaagagatcagcaagtgggacttaytaccgttatcttaatccttacaccctggca

SEQ ID NO: 2837 - DNA, 61 bp, Homo Sapiens
tgaccagttaggaaaagaatcttccatatascctatccccctgcttgggtgggtgaggcga

SEQ ID NO: 2838 - DNA, 61 bp, Homo Sapiens
agcgatagtcaaggaatgtgagaagtctctygaacctggggtcaggggcaaaaggaagtga

SEQ ID NO: 2839 - DNA, 61 bp, Homo Sapiens
ggagaggtcagaaggagagaggagtcttggkctccaaatgtagagggcactcaggggcagg

SEQ ID NO: 2840 - DNA, 61 bp, Homo Sapiens
ggtgtgggatgacctggaagggtggcgaatwgttaggtaggtgtccgcagggctgctgatc

SEQ ID NO: 2841 - DNA, 61 bp, Homo Sapiens
agaatgaagaacataattttctgctgatgcygtaccctcacccttttcagcaaagaatagt

SEQ ID NO: 2842 - DNA, 61 bp, Homo Sapiens
ggtttctttacaggctgcaagaagtgaaagkcatggctgaccgcatcattggcatgcggac

SEQ ID NO: 2843 - DNA, 61 bp, Homo Sapiens
tgtgatcatctataaaacagacattaaataygctttagaaatgcttagctatgcctacttt

SEQ ID NO: 2844 - DNA, 61 bp, Homo Sapiens
attagaaaaactgagcagcttgttatacttwttgattcatttgacaatagcaatgatggaa

SEQ ID NO: 2845 - DNA, 61 bp, Homo Sapiens
acgtgcagatctctgctgatcaccacagtgkactagtcaggtggtaagggattgtgttgta

SEQ ID NO: 2846 - DNA, 61 bp, Homo Sapiens
agtactttccttcccttctccaagctattasgtcctctgctcagggctcccataagtaata

SEQ ID NO: 2847 - DNA, 61 bp, Homo Sapiens
ctattagcgaacatcaggcactctgccaatytaggttttgagtgtttttttcatcattaga

SEQ ID NO: 2848 - DNA, 61 bp, Homo Sapiens
ttggtcaaggaaagtcacggtgccagtctcragtcaagagaaaaggtaatgaacttaatgg

SEQ ID NO: 2849 - DNA, 61 bp, Homo Sapiens
aacatataattatttaaatttgagggctacrgaattgacttcaaacagcgctgttgacctt

SEQ ID NO: 2850 - DNA, 61 bp, Homo Sapiens
aaaaggagaaaaccaggtcactggtctgcartatcttgcaaaattaattaaaaggaaaagt

SEQ ID NO: 2851 - DNA, 61 bp, Homo Sapiens
accgctgactcagtttcctttgcagaggctsaaaaatgcaaggtatttacttgataagagc

SEQ ID NO: 2852 - DNA, 61 bp, Homo Sapiens
cttgacagtattttttttgcttgtctttttygtatgcctagtagttttgattgaaagccag

SEQ ID NO: 2853 - DNA, 61 bp, Homo Sapiens
gtttcctgaggcctccccagtcacatagaayggtgagttaattacacctctttgccttata

SEQ ID NO: 2854 - DNA, 61 bp, Homo Sapiens
ggtgtacagggagatttctttcattcttgarcaagggcacaaggaaggaatgtttttctgc

SEQ ID NO: 2855 - DNA, 61 bp, Homo Sapiens
gttttcttctactctactaacagcttacccwtaaattctttcttgggtgaagccaagaact

SEQ ID NO: 2856 - DNA, 61 bp, Homo Sapiens
tgatgcctgaaacagctaagtcaggaacgaygatttataacctgggctccatggacagaac

SEQ ID NO: 2857 - DNA, 61 bp, Homo Sapiens
aatggctgttcagatttgcattttaagtagyttactctgatcaagttgccaagtgagacaa

SEQ ID NO: 2858 - DNA, 61 bp, Homo Sapiens
accaactcagatttcacctttgctggtagakgagtcatgcctatgcctgggagactggcag

SEQ ID NO: 2859 - DNA, 61 bp, Homo Sapiens
ctctgtgctgacatgatagcaatagtataakgtctgtgtctccaatggagattttgactta

SEQ ID NO: 2860 - DNA, 61 bp, Homo Sapiens
tcacttgtgtctaagattgattgttaatgtyaatataatgcatatcatctgtaaaaaggaa

SEQ ID NO: 2861 - DNA, 61 bp, Homo Sapiens
gaacaggtctgcagttcaaaccctagagcgsattctgtagtccataggaacagaaaacgag

SEQ ID NO: 2862 - DNA, 61 bp, Homo Sapiens
atttctctgctgagtcaccaccacatgaccstaaatccaaggtgacatatctatctccagc

SEQ ID NO: 2863 - DNA, 61 bp, Homo Sapiens
cttcctaggtctgctcctataaagaagcacmttctcaagacagcctcatcaacactggaat

SEQ ID NO: 2864 - DNA, 61 bp, Homo Sapiens
gcattcccggcgaaataagagcatatatctrtcatgtaaggatgctggaagcgccacacct

SEQ ID NO: 2865 - DNA, 61 bp, Homo Sapiens
gtggatatgtccttggcattgctgttgtggstagtatagtgactatctctgaggaacagca

SEQ ID NO: 2866 - DNA, 61 bp, Homo Sapiens
gagagttctgttgagacagctggaaggacasacaaatggttgagtgtgagttccgaactca

SEQ ID NO: 2867 - DNA, 61 bp, Homo Sapiens
ttgacactaaacgacatggctcgccttttayattaattgcaaacacctctcaactgtctca

SEQ ID NO: 2868 - DNA, 61 bp, Homo Sapiens
tctgcaggaggtgcagggcaaaacaggaagsatggccaagaccatggtagcaggcaggtgt

SEQ ID NO: 2869 - DNA, 61 bp, Homo Sapiens
gaggccaaacgcataatagatactcaataarttgtagctgtcgcaattattgacctcctgg

SEQ ID NO: 2870 - DNA, 61 bp, Homo Sapiens
agcccgctgtaaagcataagttttcccagtrcttgcagggagtcactagaaggatcacatg

SEQ ID NO: 2871 - DNA, 61 bp, Homo Sapiens
gggctcagctgaaggtcagccatctcttccracacaagaaaagaaaatggcggtgttggac

SEQ ID NO: 2872 - DNA, 61 bp, Homo Sapiens
tgacttatttctccttccctctattttaaastcttgattctatcatctgcttgcctgcgta

SEQ ID NO: 2873 - DNA, 61 bp, Homo Sapiens
tgctgctggaaagctgcatgactcaggcaasctcctagaccactctgagtctttgttttct

SEQ ID NO: 2874 - DNA, 61 bp, Homo Sapiens
ctcagctgttatggagtcacagaaggtcatrcctacatgaaaggcaaggcaagaagtatcc

SEQ ID NO: 2875 - DNA, 61 bp, Homo Sapiens
gaaagctcccgtagggccccttctgaatatyttggttctggctgcgggaagaaccctttgg

SEQ ID NO: 2876 - DNA, 61 bp, Homo Sapiens
tgccagggagtggggccacgaagttgggcgytgcagcatttgatgctcctgtatactgcac

SEQ ID NO: 2877 - DNA, 61 bp, Homo Sapiens
aggagccagaaacagaagatggtctcagaamgggagcggctccaggcagaactggaccact

SEQ ID NO: 2878 - DNA, 61 bp, Homo Sapiens
acttgcttcagctgaaaaggttgggtgcatygtcagtaaaaagggcttatttgtttcattt

SEQ ID NO: 2879 - DNA, 61 bp, Homo Sapiens
agcgctcaaccacatgtacaaactccgcacraacctccagcctctggagagtactcagtct

SEQ ID NO: 2880 - DNA, 61 bp, Homo Sapiens
atgtgggaacatcatagagcatccttgcacraacacagatggtagagccgactacatccct

SEQ ID NO: 2881 - DNA, 61 bp, Homo Sapiens
ttggaggacagccagttaagtatccaggccrtttaacccagagaatcaaattgcaccatga

SEQ ID NO: 2882 - DNA, 61 bp, Homo Sapiens
aagttgtgtgcgaaccttaaaagcgacactytcatttcaggacactctggagatgtgttct

SEQ ID NO: 2883 - DNA, 61 bp, Homo Sapiens
tcgcaagaatgagtggccactggaccagatrgccctgcaatgtgacatgacgaagaagaac

SEQ ID NO: 2884 - DNA, 61 bp, Homo Sapiens
ggtggatcccaagttgtgcagctttcactgyaccatgtggcagcagactctactagatcag

SEQ ID NO: 2885 - DNA, 61 bp, Homo Sapiens
tgtgagaacacagctaaaagttgccatctakgaaataggcgccaggtcttaaactccctag

SEQ ID NO: 2886 - DNA, 61 bp, Homo Sapiens
aggaagaacatggactctggagtctgttackgccagttttggttctagtacgttaaactcc

SEQ ID NO: 2887 - DNA, 61 bp, Homo Sapiens
caatagagctcagtcatgagtaaattaaaaytgcaaatcatggagacagaaatgaaagatc

SEQ ID NO: 2888 - DNA, 61 bp, Homo Sapiens
ctccatctgtgcccctttagaaaaggagtasagtaaccaagttcaggaacactattcttag

SEQ ID NO: 2889 - DNA, 61 bp, Homo Sapiens
attttcttaaagcctcccatagccactcgcrgaaggcggtaggattttcttcctttcccta

SEQ ID NO: 2890 - DNA, 61 bp, Homo Sapiens
ttaaatcacaaaaccaaagtaccttcaagtkttttggaaatccttgccaagaagggtggat

SEQ ID NO: 2891 - DNA, 61 bp, Homo Sapiens
gagctttattacataaagtgctttgtgtccwttatctcactttattctttcggcaacccca

SEQ ID NO: 2892 - DNA, 61 bp, Homo Sapiens
gtggtgcttgttaagtggcaaaagacaagtracatttaacacataaatgagaaaaaataga

SEQ ID NO: 2893 - DNA, 61 bp, Homo Sapiens
gccttaattatttgtgagttatccacggttktgcagggagcataggagctatgatgagaac

SEQ ID NO: 2894 - DNA, 61 bp, Homo Sapiens
agggtctctctctgagtgtgggttctgtccyagcttttgccatctatcttctaccaactac

SEQ ID NO: 2895 - DNA, 61 bp, Homo Sapiens
cagagagcgaatgactcccaaagtcagacargaagagtagcctagtttaacgcctatgagg

SEQ ID NO: 2896 - DNA, 61 bp, Homo Sapiens
catcgtgaccaaggatgataaatgaggcttrctttgggagcaggagttgtacagatgtgga

SEQ ID NO: 2897 - DNA, 61 bp, Homo Sapiens
attcttgaatataaccacgctggcattctcyattcacctgctgatggacagcgggtcgttt

SEQ ID NO: 2898 - DNA, 61 bp, Homo Sapiens
actcagtacttaagtgttcaactctaactgygttttggagtcttcctttcctcccatacca

SEQ ID NO: 2899 - DNA, 61 bp, Homo Sapiens
tctgcccgccccgtacatgcaatagtttggracattttgtaaataaccagaactcgcattt

SEQ ID NO: 2900 - DNA, 61 bp, Homo Sapiens
gagcctgacctcaccgtctacctgaaggctygcatgaagagtatggggaaatttcaggtga

SEQ ID NO: 2901 - DNA, 61 bp, Homo Sapiens
agagtatggggaaatttcaggtgacagatayaaaggacaaatgtttacccaaaaaatataa

SEQ ID NO: 2902 - DNA, 61 bp, Homo Sapiens
aagggcttttacatattttaagtctttaatrttcactgtaacagccatcctgtagttattg

SEQ ID NO: 2903 - DNA, 61 bp, Homo Sapiens
gggaggtttctataaagttggccttaactcygagggatatttaaagtggggaatttctggc

SEQ ID NO: 2904 - DNA, 61 bp, Homo Sapiens
aacacttcttggggggatagggtgtttgagyttggtatagggaagaataggcagagcctag

SEQ ID NO: 2905 - DNA, 61 bp, Homo Sapiens
agaccttcaacaggctgcatatacttgccaygtgaggacatcattttggaagaagatcctc

SEQ ID NO: 2906 - DNA, 61 bp, Homo Sapiens
gtctttatttctccttcatgtttaaaggatrttttcactagctatactattttagggtaat

SEQ ID NO: 2907 - DNA, 61 bp, Homo Sapiens
catcccggtgggtttgcttggcctttaggaygtgtgactacagcttttgggtaggtacagg

SEQ ID NO: 2908 - DNA, 61 bp, Homo Sapiens
gtgtgatgtattaatagcatacacgtttgtytttaagattgtatttgataaatccaggtgt

SEQ ID NO: 2909 - DNA, 61 bp, Homo Sapiens
tctatccctacaataagggtgaaagaatttyagcttttttgtgagttttaactcttaccgg

SEQ ID NO: 2910 - DNA, 61 bp, Homo Sapiens
agaagcacccaggcctgtaatcatccagagrctaggcagcccagcaaaaaccttacactgt

SEQ ID NO: 2911 - DNA, 61 bp, Homo Sapiens
cacgtggaaaaccatggtatgattccacttktatgagatacccagaatatgcatattcaca

SEQ ID NO: 2912 - DNA, 61 bp, Homo Sapiens
actgccagacctcagaaatgtcctgttcccyaaaccactgagttttgttttcatggtctca

SEQ ID NO: 2913 - DNA, 61 bp, Homo Sapiens
tgcatgatttaataacggtgggtggagaccygttatggtttctgtctaggtgactgtgtct

SEQ ID NO: 2914 - DNA, 61 bp, Homo Sapiens
ctcctccatattggtacatggtatcagcaayccctactcctgagaacatacaagaacttta

SEQ ID NO: 2915 - DNA, 61 bp, Homo Sapiens
ctgcctactgttttctcctgtcagactctayagtgctgcaaacgtgccttcattttaactc

SEQ ID NO: 2916 - DNA, 61 bp, Homo Sapiens
cccttgtgtatctccagaaaggtacagattrttggatttaaggtcaacccatgtaatctag

SEQ ID NO: 2917 - DNA, 61 bp, Homo Sapiens
aacttctgaatctcattcttggaaacttagygctagatatgaaatggaactcagggctgtc

SEQ ID NO: 2918 - DNA, 61 bp, Homo Sapiens
taggcctcatccccagagacttagatttgtkgggcctgtgatgaagccccagaatttgtat

SEQ ID NO: 2919 - DNA, 61 bp, Homo Sapiens
gcgagaagaagtaagctgggatacagaaaaytcacaccctcaacacacgatcactaacctg

SEQ ID NO: 2920 - DNA, 61 bp, Homo Sapiens
ttccttcaaaaattatcctgtgtgctgcctyccttaaagaaacacctgtgtcattggttac

SEQ ID NO: 2921 - DNA, 61 bp, Homo Sapiens
atctcagacatactaaagcttttaaaacaakccatgtgttagtctcatgaccaggagtctg

SEQ ID NO: 2922 - DNA, 61 bp, Homo Sapiens
gatggaaatgtagccactagccacatctggytactgagcatttgaaatgtggttagtgaga

SEQ ID NO: 2923 - DNA, 61 bp, Homo Sapiens
tattgttcagtgcaggcatttgcaatctttyagtgctctgagtttataattgaaactattt

SEQ ID NO: 2924 - DNA, 61 bp, Homo Sapiens
attctaagatgcagccaggtagagactgctstgccacgttatagggaaagcacccggcact

SEQ ID NO: 2925 - DNA, 61 bp, Homo Sapiens
tgaggctgtgagtgactgcaggacctgtcayatgagaactgctcaacaagtgcaagttgct

SEQ ID NO: 2926 - DNA, 61 bp, Homo Sapiens
ctatttcataccacttgctatttcttacccraatgaagtgtaagagagtgagttaagagta

SEQ ID NO: 2927 - DNA, 61 bp, Homo Sapiens
gtctccaaagttgcagcctcatctctcaaamctgagtgctctgcttggtgtcactgctcca

SEQ ID NO: 2928 - DNA, 61 bp, Homo Sapiens
aatacttaatatgttttagtataacttatcwgcccaaataactgcataagatattagataa

SEQ ID NO: 2929 - DNA, 61 bp, Homo Sapiens
tacatagttcatctgggatacagctcacaartctattctttaaacaatggttgaaaacaaa

SEQ ID NO: 2930 - DNA, 61 bp, Homo Sapiens
aaaacctcctctaggtcacactttccatctygaggttttgggaactgtggcccctctcaca

SEQ ID NO: 2931 - DNA, 61 bp, Homo Sapiens
catcttattgctgagcgtagagttctgtacmtgattgtgtatatattgtagatactagacc

SEQ ID NO: 2932 - DNA, 61 bp, Homo Sapiens
atttgaaaagtagctctctaattttgttaaygccattattggagttggataaattcgccta

SEQ ID NO: 2933 - DNA, 61 bp, Homo Sapiens
gaagctcttcatgtctccccagtggctctcrggacaaacctcaactccatactcaggctat

SEQ ID NO: 2934 - DNA, 61 bp, Homo Sapiens
aggcaagggtgaagacacacctgcaggccaytaatcttgctacacagcatccctattttaa

SEQ ID NO: 2935 - DNA, 61 bp, Homo Sapiens
aaacagggctcttcctgatctagctgttgaycacctcgttaattttatcattcatacctgt

SEQ ID NO: 2936 - DNA, 61 bp, Homo Sapiens
tcaaaatgcaaatatgaaaactatcaccttscaaccacggataacacttaaatgaattacc

SEQ ID NO: 2937 - DNA, 61 bp, Homo Sapiens
tatatacaatggcctaaaaatatgtaacgtrgaccctgactgggaagaaatctaagaaaaa

SEQ ID NO: 2938 - DNA, 61 bp, Homo Sapiens
caaatgggttttcgtgtttgaggcatgaaarctcatttaaaaattaacctaaacacaagaa

SEQ ID NO: 2939 - DNA, 61 bp, Homo Sapiens
gaagacactgaagaccaacctccctcacttyccaatgtccctagggaccagctttgttcta

SEQ ID NO: 2940 - DNA, 61 bp, Homo Sapiens
aagtaatggggaaaccaggaaggtagtgatygggccaaacctccacaaccaggactcaaaa

SEQ ID NO: 2941 - DNA, 61 bp, Homo Sapiens
tcttgtgtgtctcttccagaaatgtaccaarccttcgcatttttctctaatggttttgtgt

SEQ ID NO: 2942 - DNA, 61 bp, Homo Sapiens
gcttcagccaacacaaacagcagaaataagmcgggagaagccacctctgaatggaggttct

SEQ ID NO: 2943 - DNA, 61 bp, Homo Sapiens
tattcttggaaaacacattccaaggtgattraaatctgagatgcaaattttaaactacatc

SEQ ID NO: 2944 - DNA, 61 bp, Homo Sapiens
ccaggccagggctatagagggctggtcctaygtataaggccacctggggcctcagcctcaa

SEQ ID NO: 2945 - DNA, 61 bp, Homo Sapiens
ctagaatccttgtgaggattaaatgagttcmgaaacatgtaaagaacataggataatgctt

SEQ ID NO: 2946 - DNA, 61 bp, Homo Sapiens
ctcctgagtctgttttgggaaatcgtgggaktctgccacccaaagagccgctgcagaatat

SEQ ID NO: 2947 - DNA, 61 bp, Homo Sapiens
gggagaagtgaccagaatcagatttggtggmcaaagggcacagccagcatctgtgccatgc

SEQ ID NO: 2948 - DNA, 61 bp, Homo Sapiens
atgggaatcccacctcctctcctcactcacmctatgatcttgccaattacatcacttttga

SEQ ID NO: 2949 - DNA, 61 bp, Homo Sapiens
cgtttaacccagagcagagaaggggcttaakttttcattcaagttctagtactgtgtggcc

SEQ ID NO: 2950 - DNA, 61 bp, Homo Sapiens
gaagctcctggacttgtcagtcaactgaaaygtctcttggaagagaaacaaccaggggatg

SEQ ID NO: 2951 - DNA, 61 bp, Homo Sapiens
tcacttcacaataaatggcatctccaaagcktgtctacttggctgccatcaaaatggagaa

SEQ ID NO: 2952 - DNA, 61 bp, Homo Sapiens
tagcaaaatgtacattgtgttaacgtatcamcttgttttcataagtacaattggttcctga

SEQ ID NO: 2953 - DNA, 61 bp, Homo Sapiens
ctgagggggggaaaaacagcagataatattrttacaggaaatccataagccaaaaagaagt

SEQ ID NO: 2954 - DNA, 61 bp, Homo Sapiens
ctgtatccgtggagtttccatatccatggaktcaatcaacccagataaaaatattcagaaa

SEQ ID NO: 2955 - DNA, 61 bp, Homo Sapiens
tgtaatctttattcttcttgcctaaaaatastttgatagtctttgttgtcattgtgaataa

SEQ ID NO: 2956 - DNA, 61 bp, Homo Sapiens
ctagtgtttctgtctaccttggcaatgacawcttttggtttggatgcttcagggagccagt

SEQ ID NO: 2957 - DNA, 61 bp, Homo Sapiens
tgatttctgaattatttgcttttattccaakttaatcatggaaagttttaagaaaagtaaa

SEQ ID NO: 2958 - DNA, 61 bp, Homo Sapiens
ggaaagttttaagaaaagtaaaattgtttargatgatgacagttttgatttcagctatgta

SEQ ID NO: 2959 - DNA, 61 bp, Homo Sapiens
atattagaaacagcatttactgagttcaaamcatgtgagacatttatttgttacagtatcc

SEQ ID NO: 2960 - DNA, 61 bp, Homo Sapiens
actgaaaataatctgctgatttctcatcttrgcctttgagatcattaagaaccctgtgaac

SEQ ID NO: 2961 - DNA, 61 bp, Homo Sapiens
aatagagaaaaggggatgaaaagtagagttkgaatttgcagttgaatggttagttgtgctg

SEQ ID NO: 2962 - DNA, 61 bp, Homo Sapiens
tgaaaggtgtaaattgagtcagttgttgttratttatgaagaaatgggctgatcacttccc

SEQ ID NO: 2963 - DNA, 61 bp, Homo Sapiens
ggcatagatgctggcaaggaaggaaatgtcrcttgagctatcaaggagtcgggtcctcatt

SEQ ID NO: 2964 - DNA, 61 bp, Homo Sapiens
ctttggcatatatataacaagactggcaatrtactgagaatttgaaattaagtgataggca

SEQ ID NO: 2965 - DNA, 61 bp, Homo Sapiens
agtagctggtatctgcaagactgataaatgrgaaaacatgtcataaactgaccattctttg

SEQ ID NO: 2966 - DNA, 61 bp, Homo Sapiens
atgaagtagaattgaatgcattatacaaatkgcatctttctcaaatatgtgttgctcatcc

SEQ ID NO: 2967 - DNA, 61 bp, Homo Sapiens
tagccctgaagagctgtctacaggtttcttsattcattccctcagccccagagaaagacat

SEQ ID NO: 2968 - DNA, 61 bp, Homo Sapiens
ttcttgtctttttcaatctctgtgatcaacraatgtgcatttattttctcctttcctggcc

SEQ ID NO: 2969 - DNA, 61 bp, Homo Sapiens
aatgtcaaagtttaagctgctagaatagtcmtgggcctttgtcactgcagtgaccacactg

SEQ ID NO: 2970 - DNA, 61 bp, Homo Sapiens
aaaaaaaaaaaaaaaagctttgataaatatkgtacatgattgcaaagcgtcccatcgtgtg

SEQ ID NO: 2971 - DNA, 61 bp, Homo Sapiens
cactggccatcactcttgcttttgtaagggwtgtcacattgagccattaagtgtcatctct

SEQ ID NO: 2972 - DNA, 61 bp, Homo Sapiens
ggtggcggcaccttgagggccttacagaccyggcagttgaaggtatgggctagaagacaga

SEQ ID NO: 2973 - DNA, 61 bp, Homo Sapiens
aggaagacagagggaacattattactgtgaycaaatggctcagaatttcctgccaggtccc

SEQ ID NO: 2974 - DNA, 61 bp, Homo Sapiens
actctcagccttgggagttaggaccgagaayatggctgacggttccccagcacactcaggg

SEQ ID NO: 2975 - DNA, 61 bp, Homo Sapiens
aaacttataacacacagagatcgagggtttmactccaaacacagcacccagaggattgaag

SEQ ID NO: 2976 - DNA, 61 bp, Homo Sapiens
ccagtgaaattttacttggcctgattaagcrgaaaagctgtagtctgttgaactgaagtct

SEQ ID NO: 2977 - DNA, 61 bp, Homo Sapiens
tagaaacaagtttgctgaccccttgtggtgytttagagaaaatatttttgtagctgaacaa

SEQ ID NO: 2978 - DNA, 61 bp, Homo Sapiens
ctacataaacaactgttgttttccaagttgrataaaagggataaacctttcagtctaggct

SEQ ID NO: 2979 - DNA, 61 bp, Homo Sapiens
atgagaataacagttctcatgacttgaatgmctgatgttttgggttttttttcacccttca

SEQ ID NO: 2980 - DNA, 61 bp, Homo Sapiens
gggacctcacctgaggcatttcctgagcacytctgctaaaacatctttattgagggtgtca

SEQ ID NO: 2981 - DNA, 61 bp, Homo Sapiens
cagattctctagggactgatcagaatctgcrttaaaccaagctctccaggcaactgatgct

SEQ ID NO: 2982 - DNA, 53 bp, Homo Sapiens
aattaagccacacatgtattccacagaaacyatattgctgcataacaaattac

SEQ ID NO: 2983 - DNA, 61 bp, Homo Sapiens
atcttgggagtgaagttagaaaaggatgtcmtaaacaagatgcaaatactactaatcacaa

SEQ ID NO: 2984 - DNA, 61 bp, Homo Sapiens
gtatctctgaggatgccgattggtgtgccaycctagactaggacatgataccctttttcta

SEQ ID NO: 2985 - DNA, 61 bp, Homo Sapiens
cattgatcagttaacaatgtgtgtgatatartctgaaaaatcccaaagactcaagggaaaa

SEQ ID NO: 2986 - DNA, 61 bp, Homo Sapiens
ctgtggtcagggctttacatgcattatctcwtatgattttcccaaacaactctttagttag

SEQ ID NO: 2987 - DNA, 61 bp, Homo Sapiens
atacaacgttttcctcagcttttactttgcygcagatgtgctttcggtaatatggtcatca

SEQ ID NO: 2988 - DNA, 61 bp, Homo Sapiens
aggcacaagggagaatagggcattttatttyctggaattactgacaaattatttcttcaaa

SEQ ID NO: 2989 - DNA, 61 bp, Homo Sapiens
taaatgacttggttaaatatattggtatggrgcaatgtataatcacagtcttattaccttc

SEQ ID NO: 2990 - DNA, 61 bp, Homo Sapiens
atttttcctattttccaccaatatctcagtyttgttacaggaaaaatgttgaagactttaa

SEQ ID NO: 2991 - DNA, 61 bp, Homo Sapiens
atgttaagataataacataatactctttggrttcagcaatctttgacatttattttctcca

SEQ ID NO: 2992 - DNA, 61 bp, Homo Sapiens
ctgggtaatatagtgatactctgtctcttaygtgaaaaaaaaagaaaagaaaaaagaaaaa

SEQ ID NO: 2993 - DNA, 61 bp, Homo Sapiens
catgttcttttagcgaactgagcactccctwcagggtcattttagaatactgttttattgc

SEQ ID NO: 2994 - DNA, 61 bp, Homo Sapiens
caagtcctaagtaaaatataacaaacatttmaatgcatagttccacttacaagaaagaaaa

SEQ ID NO: 2995 - DNA, 61 bp, Homo Sapiens
acaatacagtgctaaaatgacaatgttataygacaaacctgtagaacttattcatcttgca

SEQ ID NO: 2996 - DNA, 61 bp, Homo Sapiens
gtggtgttttccatcaccaagagagccctcraaaaccaagtgcggcttcacaaccaggaca

SEQ ID NO: 2997 - DNA, 61 bp, Homo Sapiens
ttacttaaagttgattttcttgctgacattmttccttggtactggtgaaggttaggaattt

SEQ ID NO: 2998 - DNA, 61 bp, Homo Sapiens
ggtagagatgttaacagttgcctgaaacttygatgtgctttcacgcccacaggaaaggtaa

SEQ ID NO: 2999 - DNA, 61 bp, Homo Sapiens
gttctcataatagccgattgctataaaaccrtgacagctgcgtaggcccggggccctttca

SEQ ID NO: 3000 - DNA, 61 bp, Homo Sapiens
atatcaagctaaagaatctaaccttacacamaatggcaccgataaaggtgaaggatttttc

SEQ ID NO: 3001 - DNA, 61 bp, Homo Sapiens
ggaggacaagagtgaaactccattcccctcygcaaagaaaaggaatattatcagattccta

SEQ ID NO: 3002 - DNA, 61 bp, Homo Sapiens
tggtgccaggaagcagggccaatgctaagawtttcattattactaccaccatcaggagatt

SEQ ID NO: 3003 - DNA, 61 bp, Homo Sapiens
tgggctccctagggacatctccatcaggaakatcctttgttcctgaccccacctcctctac

SEQ ID NO: 3004 - DNA, 61 bp, Homo Sapiens
gaataatcctgtgtttccaccacagattaartttacttcatatgtgttcctgaaaagttag

SEQ ID NO: 3005 - DNA, 61 bp, Homo Sapiens
tgagaacaagctgtgggtaaaggtaaaaatycagcagtttcagcctagtggtatctttttg

SEQ ID NO: 3006 - DNA, 61 bp, Homo Sapiens
actgtcctctggagatttagcactgatcctrttgaagcacaggttggatgagttgcttatt

SEQ ID NO: 3007 - DNA, 61 bp, Homo Sapiens
atttttactcacattacaactaaccgccttmaagtatacaattcagtggtaagtagtgtac

SEQ ID NO: 3008 - DNA, 61 bp, Homo Sapiens
agtagcataaccggaattatcactgaaatargcttgcacagtatcgcaatttcatggaagt

SEQ ID NO: 3009 - DNA, 61 bp, Homo Sapiens
tcctctgccttctggctttgatctggctcayggtgaaataagcttgccaggaggctggcag

SEQ ID NO: 3010 - DNA, 61 bp, Homo Sapiens
aacgcaggcacataccagggcgcatacgtgrgagcggcatttgcagtgcgagtgcatcgcc

SEQ ID NO: 3011 - DNA, 61 bp, Homo Sapiens
tgtggattcagagcactggtggcctctccamctccaattgacaccagaaaacatataaata

SEQ ID NO: 3012 - DNA, 61 bp, Homo Sapiens
gcttctccaggccattctctctaaagtaggytccttctgctactgcatcattatctgtttc

SEQ ID NO: 3013 - DNA, 61 bp, Homo Sapiens
catctttctgcttgctctattgttcctctgytattaccatgagaaaaacgggcccagtctc

SEQ ID NO: 3014 - DNA, 61 bp, Homo Sapiens
ggactccatttagatctgctacatggattcyattcagtggctcaggtgatgacctggggaa

SEQ ID NO: 3015 - DNA, 61 bp, Homo Sapiens
gagttccctgggctgctctccatcatccagrgagcggtgaagcaaggacctaggtctctcg

SEQ ID NO: 3016 - DNA, 61 bp, Homo Sapiens
aactggctctttctcatcactgattgtgctmacagtagggaagagataataattgcaagac

SEQ ID NO: 3017 - DNA, 61 bp, Homo Sapiens
gatcacagtgtcctccaatgccatgtcccaytatcctgagtcttcctgtcacctttgggtt

SEQ ID NO: 3018 - DNA, 61 bp, Homo Sapiens
ttggttatggggccagcttgagaatccataygtcctgactacctgcaccacttctcctttt

SEQ ID NO: 3019 - DNA, 61 bp, Homo Sapiens
ggtaatacttgagcaggagacagcatgtggytgggccttaaatgacaggtagggactgaac

SEQ ID NO: 3020 - DNA, 61 bp, Homo Sapiens
gaaccacagcttccttgaaagctcgtgccarttattaaatgctgtaggcaaggatgtaaac

SEQ ID NO: 3021 - DNA, 61 bp, Homo Sapiens
ctacattaggctataacttttctttggatcmgtgccatgtgaacactagaaaccaacacag

SEQ ID NO: 3022 - DNA, 61 bp, Homo Sapiens
tgggcaccaccagcagcaaccactctggtgrctttaatttctggtaagtcagacttttaaa

SEQ ID NO: 3023 - DNA, 61 bp, Homo Sapiens
agaatgatgctggcctcacagaatgagttargcagaagaccctcctcctcagatttttaga

SEQ ID NO: 3024 - DNA, 61 bp, Homo Sapiens
gactgtattttcttataactcagagctttaraaacccgatgcaactacctaatgccagtaa

SEQ ID NO: 3025 - DNA, 61 bp, Homo Sapiens
ttgcttactgtttttatcatttggtcaaaaytgaaacgtaagttttgtatctctatccaga

SEQ ID NO: 3026 - DNA, 61 bp, Homo Sapiens
accattgcatgtagaacaaattggatttacrttgaaattacaccagacaggggcaatgata

SEQ ID NO: 3027 - DNA, 61 bp, Homo Sapiens
tagaccccaatagtttacacaaatggaatgmaggatctctatatttataccccaatctgtg

SEQ ID NO: 3028 - DNA, 61 bp, Homo Sapiens
ctccgagtaaaagccagagtctttaccgtgrcccaccaggcctgtgtgatctgactccttt

SEQ ID NO: 3029 - DNA, 61 bp, Homo Sapiens
tgcagttctgctaaatactaacatttcaaarcagagacagttgtttcttttgcattttata

SEQ ID NO: 3030 - DNA, 61 bp, Homo Sapiens
cctcagcagcagaaggcaggtaaacatgacmacaaagtgggaagaaatcagacatggtaaa

SEQ ID NO: 3031 - DNA, 61 bp, Homo Sapiens
gcctgagttacatagatgacaaatgcatgcyaagttaggtgttaacaggcagaattctaag

SEQ ID NO: 3032 - DNA, 61 bp, Homo Sapiens
atgttgtgaggtaggagcctatcttcattcktttgcgtgtgagataccatatgtggtcttt

SEQ ID NO: 3033 - DNA, 61 bp, Homo Sapiens
ttttagtcaatatgaatttatcactagtctytgttcacatacacatagtacacatcttttc

SEQ ID NO: 3034 - DNA, 61 bp, Homo Sapiens
gttggtatcttattatggtttcgactttcayttccctgatccttaatggtattaagcatct

SEQ ID NO: 3035 - DNA, 61 bp, Homo Sapiens
ttccttttaaggacccacttgattaggtcasccctaccaggataatctcccttttgattac

SEQ ID NO: 3036 - DNA, 61 bp, Homo Sapiens
gaagctgtgtttcccaataacactgccaacrttgtacattatcaaaccttctaatctatgc

SEQ ID NO: 3037 - DNA, 61 bp, Homo Sapiens
ggcagttcgtttggcagtccagccttgtgaytggaaaaggacatcaccatgcctccctgca

SEQ ID NO: 3038 - DNA, 61 bp, Homo Sapiens
ctcgcaggccaaggaggaggtgatgaagggygagtctgagcataacctgggaccacaccga

SEQ ID NO: 3039 - DNA, 61 bp, Homo Sapiens
tgtttttcttgagggactccctgtggtttgktgatccttagtgagcttggggttcttaata

SEQ ID NO: 3040 - DNA, 61 bp, Homo Sapiens
tagcaaagattggtcactgttgacttatctstcatttacttataataggtatcatgtatcc

SEQ ID NO: 3041 - DNA, 61 bp, Homo Sapiens
ggcttttctactccagtactcgttcctgcgraggcttctgctaagggatttctgctcagat

SEQ ID NO: 3042 - DNA, 61 bp, Homo Sapiens
agacgaacaatgatgcctgctgtgggaaatktgcattttaaaatgcagttttcctccttta

SEQ ID NO: 3043 - DNA, 61 bp, Homo Sapiens
gcaacatgagatgagactagagagacaagamagggccagcttattcaggggagaaatgttg

SEQ ID NO: 3044 - DNA, 61 bp, Homo Sapiens
ggccgccatgttgattttctgtaaatgatcyggattatatggtggtttcaaaatagccaac

SEQ ID NO: 3045 - DNA, 61 bp, Homo Sapiens
tgaattaaataatttaattatcacaaagatsctatgttatagtcataattattcccctttt

SEQ ID NO: 3046 - DNA, 61 bp, Homo Sapiens
ccaaggcaccctaactagccatttgcatagrgcattgtggtagatgtggctctgaaatgtg

SEQ ID NO: 3047 - DNA, 61 bp, Homo Sapiens
tagagagatacattcctaaaataatgctgcsgaaagtccactctaaaccatctaccttaag

SEQ ID NO: 3048 - DNA, 61 bp, Homo Sapiens
tgtgtctcctccatattcagtcataaaagtyctaacccccagtatctcagaatgtgactat

SEQ ID NO: 3049 - DNA, 61 bp, Homo Sapiens
ccttgaaacacacgtagcttttcaaaaggayaaaacagtgtgatgtccgttgtttcctata

SEQ ID NO: 3050 - DNA, 61 bp, Homo Sapiens
tttagtaaaacaaagcagttttactgtacamagaagtgcaatgctacattaagtcctgagt

SEQ ID NO: 3051 - DNA, 61 bp, Homo Sapiens
ggctcagggctgttgttataggctggattaygacaccctaaaattcatgttgaagccttaa

SEQ ID NO: 3052 - DNA, 61 bp, Homo Sapiens
tggtgcaaaaggaagttacaggactagggasttctgaattatttatctttctccttccatt

SEQ ID NO: 3053 - DNA, 61 bp, Homo Sapiens
taggtactaggaaggtgagaataaaagccayagctcctatccctggaacagctcatggcct

SEQ ID NO: 3054 - DNA, 61 bp, Homo Sapiens
agttttgaaaatgtgctaggcaaggtgtatyagtatgagtacctgccctcctctcggggta

SEQ ID NO: 3055 - DNA, 61 bp, Homo Sapiens
attgtactgtcagaaaccttttggtatgtcwcatcttactcacctttatacgttcagcaga

SEQ ID NO: 3056 - DNA, 61 bp, Homo Sapiens
tttatgcccatcactattgtctcctttttcyttctccatcgttaaataaataaataaataa

SEQ ID NO: 3057 - DNA, 61 bp, Homo Sapiens
cgaagcagggtgttgtaactttccagcctgyatctggttatgattgctgtggctctctgga

SEQ ID NO: 3058 - DNA, 61 bp, Homo Sapiens
atttttttcagctccaatgtgggaatgttayagctaaagagtattgttaaaggctattgtg

SEQ ID NO: 3059 - DNA, 61 bp, Homo Sapiens
ggtctccagcttcccagccctcagcatgcamggtgagatggatcctcctagaatacaagtt

SEQ ID NO: 3060 - DNA, 61 bp, Homo Sapiens
gctgagagctctctcttctctgttacaaaaygagataagcaagtgttagaattgccttaag

SEQ ID NO: 3061 - DNA, 61 bp, Homo Sapiens
gtggacctggccatgcccatggcagacgggmgagaattcaacctgcgacgtggtgaccgcc

SEQ ID NO: 3062 - DNA, 61 bp, Homo Sapiens
gacatgtggtctctgtggtccctcagagacstttgaacatgagggtatccaggtctgaccc

SEQ ID NO: 3063 - DNA, 61 bp, Homo Sapiens
gacacagtcttgggactcttggtgggaacaytgtaagagattcagagtctcacagagccag

SEQ ID NO: 3064 - DNA, 61 bp, Homo Sapiens
gtatctgtcttcattggtcaaaccagtaggkctgggagctccctgctgcagagaatcccga

SEQ ID NO: 3065 - DNA, 61 bp, Homo Sapiens
aggggtggatttgggggttttcttcctgctrtatttgttccagagccatctggtgagcacc

SEQ ID NO: 3066 - DNA, 61 bp, Homo Sapiens
acctgatctgaagcgcctgctgactacaccrtgtaaatactgccatcttggcagatttcaa

SEQ ID NO: 3067 - DNA, 61 bp, Homo Sapiens
gtctttggagagacctcgggaagatgacctytgaaccacagctgctagaatcctgggccat

SEQ ID NO: 3068 - DNA, 61 bp, Homo Sapiens
atgcttgtctgtgtgccttactgtgtgtacrttatcaacaaagtagtttacttaaactaga

SEQ ID NO: 3069 - DNA, 61 bp, Homo Sapiens
gaactcatctccctgaagacttgctattagrggagataatgacatgtttttgtgctgaagc

SEQ ID NO: 3070 - DNA, 61 bp, Homo Sapiens
acttccaggcatctccaatgaattacagctrctgaactaaaacatcatcaggccattgtca

SEQ ID NO: 3071 - DNA, 61 bp, Homo Sapiens
ccccgagaaccagttcagagtggactacatyctgagtgtgatgaacgtgcctgactttgac

SEQ ID NO: 3072 - DNA, 61 bp, Homo Sapiens
tcatttcacctgcgctgtggacactgagaayatccgccgtgtgttcaacgactgccgtgac

SEQ ID NO: 3073 - DNA, 61 bp, Homo Sapiens
cttcctccatctttagtaatcactcactcargttccttaatcacatctgcaaagttccttt

SEQ ID NO: 3074 - DNA, 61 bp, Homo Sapiens
gaacacaaaggggagagtgtaaaacaataarttcacagaaatttaatccaaccaacattca

SEQ ID NO: 3075 - DNA, 61 bp, Homo Sapiens
gggaggagttgatttgagggacttctcttcrtaggtggcaatggcaagtattcttactggg

SEQ ID NO: 3076 - DNA, 61 bp, Homo Sapiens
cccactatttttaaggaagaaatcattttgsttgaaggcatcactcttggttgtgatcaga

SEQ ID NO: 3077 - DNA, 61 bp, Homo Sapiens
gtagggggaatagctggatgggcccattttyaccaggatccctcctgtcatttttcaaacc

SEQ ID NO: 3078 - DNA, 61 bp, Homo Sapiens
ttctgggccatgcaggcctctccagcctcawgctcatcactgggcagacgtactgtccttg

SEQ ID NO: 3079 - DNA, 61 bp, Homo Sapiens
aggaagaactgaccagctgcacatgcatttratgatggacttctataaccatcttgttcac

SEQ ID NO: 3080 - DNA, 61 bp, Homo Sapiens
caaaattaactttctggaagtcccacaaaaygtttccacttaatcacagtggtcagcactt

SEQ ID NO: 3081 - DNA, 61 bp, Homo Sapiens
agcaggactggcgactgatctgtcaccggcraggctgggattgtttccttcctttacctcc

SEQ ID NO: 3082 - DNA, 61 bp, Homo Sapiens
taggagttaggcgtagcttcaggacggcccrctttggaatccaatcaatgggagcatagtg

SEQ ID NO: 3083 - DNA, 61 bp, Homo Sapiens
attcacagtgagggaggcccagttctgcccrcagacatacattccctagatctgcacgtca

SEQ ID NO: 3084 - DNA, 61 bp, Homo Sapiens
ggcctccctgtggggccacacatcaccctawacggcctcactgtggggccatgtctgtctt

SEQ ID NO: 3085 - DNA, 61 bp, Homo Sapiens
cgagtgggacaagtttgaccttatcacagargcatgggtgtgactcaggccgaagagaagt

SEQ ID NO: 3086 - DNA, 61 bp, Homo Sapiens
gaattgctaaatctcttggtgtccactgaartctttggtagcacaagaatatatgtgtgta

SEQ ID NO: 3087 - DNA, 61 bp, Homo Sapiens
atgatggttatccgggtcccaagtccaaagwaagctagaaaaggctgctaactgggggagg

SEQ ID NO: 3088 - DNA, 61 bp, Homo Sapiens
tccctgacagcccctgaggcaccgtctgaarcagggtcggagctggatggatcctggggag

SEQ ID NO: 3089 - DNA, 61 bp, Homo Sapiens
cctccatggattctcaccagaggcagccttygcattcccaccaactccccggaaaaggttt

SEQ ID NO: 3090 - DNA, 61 bp, Homo Sapiens
cgatttctcagctcagatgacctacacaacytttttggtctatccccgcatgtgtgtctct

SEQ ID NO: 3091 - DNA, 61 bp, Homo Sapiens
cacactaaatgcttacttgcagatccacctrggtagttctccgtagagggaagagcttccc

SEQ ID NO: 3092 - DNA, 61 bp, Homo Sapiens
ttcaaagtcatattctaatgctccaatttcraaaatagttactagtgtctggtaattctac

SEQ ID NO: 3093 - DNA, 61 bp, Homo Sapiens
tgaatagggacaggtcagttttttctgaaargtgtcattccacccccgtttcccagcctgt

SEQ ID NO: 3094 - DNA, 61 bp, Homo Sapiens
ttgcagaattcctaccatatgtaaagtagcrtatgtaaagcatatgtaaagttccacaaaa

SEQ ID NO: 3095 - DNA, 61 bp, Homo Sapiens
tttacccctggttcatagcgcttaccttgtycactcctttcaatcaccaacttatatttta

SEQ ID NO: 3096 - DNA, 61 bp, Homo Sapiens
agcgcttaccttgttcactcctttcaatcaycaacttatattttactgtctattacaataa

SEQ ID NO: 3097 - DNA, 61 bp, Homo Sapiens
tacatgagttaacaagacagcctgaggatcwttcaaagctcacaatatagatatattttac

SEQ ID NO: 3098 - DNA, 61 bp, Homo Sapiens
aactcccacattaaattttgcaattgccccytaaaattacatagccagtacagttcctgac

SEQ ID NO: 3099 - DNA, 61 bp, Homo Sapiens
caccaatagtttttcacaagtcaaagccatrtcatgtataacaggtaattacaagagaaca

SEQ ID NO: 3100 - DNA, 61 bp, Homo Sapiens
aaaacatagctcctcctttattagaagtctrccatcaacaggagtttaaattaaaccgcag

SEQ ID NO: 3101 - DNA, 61 bp, Homo Sapiens
actgtactggttgtcaaaaaatactgaattktgtcctggatattgtaaatattatgttgtg

SEQ ID NO: 3102 - DNA, 61 bp, Homo Sapiens
tcttgggctgctaataattttgctaagattrtaagagcaattatcaatgagttcagtctaa

SEQ ID NO: 3103 - DNA, 61 bp, Homo Sapiens
gtatgcaaggtcacaaataagcctaggttaktttatgtgaagctttgtaaagagtcataaa

SEQ ID NO: 3104 - DNA, 61 bp, Homo Sapiens
atatgaatgggcagagtgaggaggcgggcakttcagtccatagaaagtagattgaatttcg

SEQ ID NO: 3105 - DNA, 61 bp, Homo Sapiens
tatttggattgaagtacatatcttgaatcarattaaagttgtacagcatgtaaggctaaat

SEQ ID NO: 3106 - DNA, 61 bp, Homo Sapiens
tcaatggatacaaaagtatgtaatagaaggrggctgatgatcagggagggatagaaaaatt

SEQ ID NO: 3107 - DNA, 61 bp, Homo Sapiens
agaatactagtatgttatcaaaattacaatrtcttcttgcctccttctgaaggacactcca

SEQ ID NO: 3108 - DNA, 61 bp, Homo Sapiens
ctcttgaagtaaagatgcaaaaatttattcygactcaaaataacatttaactctgttcatg

SEQ ID NO: 3109 - DNA, 61 bp, Homo Sapiens
cttaccaaacccactgtacatcttacactcrtgaatattttatgattttcaaaacaccttt

SEQ ID NO: 3110 - DNA, 61 bp, Homo Sapiens
tcagaaaaataacaatcagtttcctttgacrttcaacattgccataagaaattctcaggtc

SEQ ID NO: 3111 - DNA, 61 bp, Homo Sapiens
tcctctatgagcaaagcaccttcatcatttkattagttaagccacagatttcatttgtttc

SEQ ID NO: 3112 - DNA, 61 bp, Homo Sapiens
ctgacttaggcagattttgcttaggatataytttatctgtcaactctccttggtatgtgga

SEQ ID NO: 3113 - DNA, 61 bp, Homo Sapiens
ctgtgcaaaaagcctggtgttcagcgtcacrggtcccagtgacttctgtaactgggcagca

SEQ ID NO: 3114 - DNA, 61 bp, Homo Sapiens
cctctcacaatagctcatcagtcctgagagmgcggccactcactcctgcggattcattcct

SEQ ID NO: 3115 - DNA, 61 bp, Homo Sapiens
atgtggataagtttgaaatgttttatcttgmgaaagatttgaccacttaggggttggaggg

SEQ ID NO: 3116 - DNA, 61 bp, Homo Sapiens
aaactttaatctggacttatctgcatcagcrttgccctaggtaactattgctcagctttct

SEQ ID NO: 3117 - DNA, 61 bp, Homo Sapiens
tggagagaatttaactccaagatcatccccygtgcactctgaggggctgggacaggatgtg

SEQ ID NO: 3118 - DNA, 61 bp, Homo Sapiens
ttggtgtttaaaattgtaaagattttccacrttacctgtaaccatcaaaccacatgtattg

SEQ ID NO: 3119 - DNA, 61 bp, Homo Sapiens
cattcgccaagaacacgtcaggtctcagtascttcgagggagtttactggccgtgcccttc

SEQ ID NO: 3120 - DNA, 61 bp, Homo Sapiens
aaccaaggccacacccctagcaagaggacckgctttcaccagtaactgaagctgtgcagag

SEQ ID NO: 3121 - DNA, 61 bp, Homo Sapiens
gatgtcacagagacaggcgggtcactagaaytgatcgtggatagtgaatgaagcaaaatgt

SEQ ID NO: 3122 - DNA, 61 bp, Homo Sapiens
ctcctctgtgggtatgtgcagtatctggcayatgaagggcactcaacaaccttgtttccct

SEQ ID NO: 3123 - DNA, 61 bp, Homo Sapiens
gaagcccttagaatcttcactgtaagcttcycaaactcaacaaatatgttgaagaaagatc

SEQ ID NO: 3124 - DNA, 61 bp, Homo Sapiens
actattacactgtttagcctttttcttcatytcattccattttttgctgttgttgagaata

SEQ ID NO: 3125 - DNA, 61 bp, Homo Sapiens
gcagataaaagcagacaagtcgtgcctactycaacttcagaggagactgtgctcaagtcct

SEQ ID NO: 3126 - DNA, 61 bp, Homo Sapiens
tgttaacactgaggtgtgatttaccttcttyactcgattcttttatgcatgtagagtcgag

SEQ ID NO: 3127 - DNA, 61 bp, Homo Sapiens
tctcctgatgggtcttcttgtacctactctwgccttcctccaatgtatttccatacctcta

SEQ ID NO: 3128 - DNA, 61 bp, Homo Sapiens
agcaatataacaaaggataggagagaagaaytggaaaaacactgtagtaaggtccatacac

SEQ ID NO: 3129 - DNA, 61 bp, Homo Sapiens
agaaaattaaaagcaagccatctacatacakttctaatcaaatatgaggattccagcattc

SEQ ID NO: 3130 - DNA, 61 bp, Homo Sapiens
aatgatcactacctcataccccatatctagygcttcagcaagtcttgtcgattctaacacc

SEQ ID NO: 3131 - DNA, 61 bp, Homo Sapiens
ctccaccccatttatagaagtgatcagaggygaatgaggaaatagtgggggaactgacccc

SEQ ID NO: 3132 - DNA, 61 bp, Homo Sapiens
catgcttccaccatgcctagccaatgagggytccataaaaggcccaagaggacaggctttg

SEQ ID NO: 3133 - DNA, 61 bp, Homo Sapiens
tccacagtcaggcctgaccagtccaggaagmtccggcaaccctggcttggccccagcctct

SEQ ID NO: 3134 - DNA, 61 bp, Homo Sapiens
gccaaagaaggctcctggctgtgttcatgtygtctctcaagggatcctggcaggctgagcc

SEQ ID NO: 3135 - DNA, 61 bp, Homo Sapiens
ggcctatttcatggcaaagttgtgaggatgrggaggataaaacaaagtacttggcacaaag

SEQ ID NO: 3136 - DNA, 61 bp, Homo Sapiens
accattgaatgtataacccgagacaaggaasctcagctctcttagcctcagattccctgtc

SEQ ID NO: 3137 - DNA, 61 bp, Homo Sapiens
ccttcccctgacatggtggcatttattacaygtgttatgggctcggagaggagctgggggc

SEQ ID NO: 3138 - DNA, 61 bp, Homo Sapiens
ataggtgtgagccactgtgcccggccaatcrtgactcttagttgcaaacaatggaaacccg

SEQ ID NO: 3139 - DNA, 61 bp, Homo Sapiens
ggtatggcctaaaggccagcaggtcaacagrtttgactgccttgtacagaaggaaggaagg

SEQ ID NO: 3140 - DNA, 61 bp, Homo Sapiens
cgttggccaggatggtgtcaacctctttatyttgtgacctgcccacctcggcctcccaaag

SEQ ID NO: 3141 - DNA, 61 bp, Homo Sapiens
gggcgtagcagcagcaacaccacgtgcaaaraccgatgcagacttgtgttccagaggttgg

What is claimed is:

1. A method of determining relative risk of developing bipolar disorder (BD) versus schizophrenia (SZ) in a human subject, the method comprising:
obtaining a sample comprising genomic DNA from the subject;
determining the identity of an allele of a single nucleotide polymorphism (SNP) at rs2291100 in the sample; and
identifying a subject who has a cytosine (C) allele at rs2291100 as having an increased risk of developing SZ instead of BD, as compared to a subject lacking a C allele at rs2291100.

2. The method of claim 1, wherein determining the identity of an allele at rs2291100 comprises:
contacting the sample with a probe specific for an allele at rs2291100; and
detecting the formation of complexes between the probe and the allele,
wherein the formation of complexes between the probe and the allele indicates the presence of the selected allele in the sample.

3. The method of claim 1, wherein determining the identity of an allele at rs2291100 comprises determining the identity of the nucleotide at position 31 of SEQ ID NO: 509.

4. The method of claim 1, wherein the subject is a patient having or suspected of having BD or SZ.

5. The method of claim 1, wherein the subject has one or more risk factors associated with BD or SZ.

6. The method of claim 5, wherein the risk factors associated with BD or SZ include one or more of: a relative afflicted with BD or SZ; and a genetically based phenotypic trait associated with risk for BD or SZ.

7. The method of claim 1, wherein the subject has exhibited or exhibits symptoms of psychosis.

8. The method of claim 1, further comprising selecting or excluding a subject for enrollment in a clinical trial based on the identity of the allele.

9. The method of claim 1, further comprising stratifying a subject population for analysis of a clinical trial based on the identity of the allele in the subjects.

10. The method of claim 1, further comprising confirming a diagnosis of SZ or BD using psychometric instruments.

11. The method of claim 1, further comprising selecting a treatment for BD if the allele in the subject indicates that the subject has an increased risk of developing BD, or selecting a treatment for SZ if an allele in the subject indicates that the subject has an increased risk of developing SZ.

12. The method of claim 11, further comprising administering the selected treatment to the subject.

13. The method of claim 11, wherein the treatment is psychotherapy.

14. The method of claim 7, wherein the psychosis is associated with BD or SZ.

15. The method of claim 1, further comprising recording the identity of the allele in a tangible medium.

16. The method of claim 15, wherein the tangible medium comprises a computer-readable disk, a solid state memory device, or an optical storage device.

17. The method of claim 1, comprising determining the identity of both alleles at rs2291100 in the sample, and identifying a subject who has two C alleles at rs2291100 as having an increased risk of developing SZ instead of BD, as compared to a subject having one C allele at rs2291100 or lacking a C allele at rs2291100.

* * * * *

UNITED STATES PATENT AND TRADEMARK OFFICE
CERTIFICATE OF CORRECTION

PATENT NO. : 8,129,117 B2  
APPLICATION NO. : 12/612521  
DATED : March 6, 2012  
INVENTOR(S) : Mark David Brennan et al.

Page 1 of 1

It is certified that error appears in the above-identified patent and that said Letters Patent is hereby corrected as shown below:

Title Page, Col. 2, Line 2, Item [56] Other Publications, delete "Curent" and insert -- Current --

Title Page, Col. 2, Line 2, Item [56] Other Publications, delete "Pharamacology" and insert -- Pharmacology --

In the Claims

Col. 153, Line 13, Claim 2, delete "1," and insert -- 1, --

Col. 153, Line 21, Claim 2, after "presence of the" delete "selected"

Col. 153, Line 28, Claim 5, delete "1," and insert -- 1, --

Signed and Sealed this  
Sixteenth Day of April, 2013

Teresa Stanek Rea  
*Acting Director of the United States Patent and Trademark Office*